United States Patent 10,233,495 (METHODS AND COMPOSITIONS FOR SCREENING AND TREATING DEVELOPMENTAL DISORDERS) - sequence listing, part 189

SEQ ID NO: 1298 - DNA, 27646 bp, Homo sapiens
aactcccaagccccacccctgggcttggcctgccttgccctgccgggaagtgatccccaaggcagggtgagagttccccatctgaggcgtttgttgcagctacctgcacttctagatgtgagtacattgtactagccccccaaaccccaaatcaggggcagatctttgtatcccttgaggctctctttagtcctgtcttgctttgaagggccttgcttctgctggggcagggaaaacatgtctgaatcagagtggggaaggaggatgggtggtggctttgcttttggaggtttcactttccaatagttgggagtcttctgggttttgaagtaaaggcagattaacaccaacaccggtcccccacccccctgcaactctcaggcctctctctgacttcagggtcccacctgggaaatcaggtggggaaccttacagggtcattcagaccccatcttagccctagatcggtgcttgctctactcacctgcactgtcctggggacctgggctctggcctgtcaccttgagctccaagaatgtgacctgtacccattcaggccccttaactctgacagatgagggtttcttactcctccatgcagggctgggccagctgttggtctcagtcgatcattcaggaagtcattagcagagtgatttccagaaggcgtagaatttagtgaccaaggttctttcctttttgggaggagaaagtgaaaactaggatgctcagctggacccaccagcctgagattctggggattttagagctgtcccttggggagccaagcacttgggggtggaggtgatagcgaggctgatggcccctgtgttctcagctctctgcctgggtagcccctgggtgatgggggagaggccagctgtcacgtggggtatcaggtggctctgccagaaactcccttggcacacagagcactgggtcggccctcgggtgtggctgtttgggcaggacagccctctgtatgtagccttgagcaggtaggggggccaccttgagtgggtggcccagagacagcctcagggctccaaggtaacggggtgctcaggttatcttgggtgctgccctcccaggttctgggggagcagaggctgggcgctggcccaacttacaggaaacactcacctttgaactgccattagcaccatctgggcagtacacagccccacccaggtcctctagttcttgttctcggcttagaatctttgtgtttctgcctgagaagccactgcctcctagtttgtggtctctacagttatagccaggttggacttccggctccgtcctttgataactgtgtgctcttgggcaaatttcttaacttgcaggttcttgtgaggataacatgagttaattgagggcacttaacactacctggcacagattaagctcatctgaagtgggagctgttacttaggggcgtttgcctagaacacagggtccagaggctctctcccggaaacttagacccagtgagtcagaagtgaggcctgcaaaaagcagcaggagtggggttaagaattccagcctagggctggatgcggtggctcaggcctgtaatcccagtactttgggaggcccgaatgggaggatggcttgaggccaggagttccagaccagcctgagcaacatagcgagaccctgtctctgtttgtgtgtgtgtggttggggttttgttttttttttttttttaaagaattatagctcagtcctatgattaggcaagttgagaaaatattgatgaagatcaggggtgctgaagcctggttcctggggtcgcttctgatctaggcggttcttgcctctggtgactggtgttaattggcaggagtgggaggagggaggacaagtggaagtctaggctggctgagctgttctgtctcgaaaagttcctaaaactgtgctgctttaaaaaaaaaaaaagtaatttatgagacacattctcaatttccattaatcatctcctaaagggggtaaaccaggaagccgctgggtgaaaacaggctgttggcaattcctgagtcatgtgacccattctctaaagactagaatatttaacttaaatcagtgagaaactctgtgaagttgtgtccttgtttataccaaacttcatgtgccttttcctgaacctgaagctgtgggaaggtctgggggcagggccgcatcaccgaccttacgtccaacctcaggactgcctggagcaagagccctggggttggggacaaaggaggctgcctggacctgggtaagggaaggggctggaggagaatgagtgcaattccctgcccttcacagcctgcaatcggagctgtgtttttgtttttgagacagagtctcgctctgtcccccaggccagagtacaatggcgcaatctcgactcactgcaacctctgcatccctggttcaagcaattctcctgcctcagcctcccgagtagctgagactacagttgcctgccaccatgtacggctaatttttgtatttttagtagagacgaagtttcaccatgttggccaggctggtctcgaactcctgagctcaggcaatccgcctgccttggcctcccaaagtgctgggattacagccactgcgcccggcctgaaactgatctttatcctcctcccagttcctactgtgcaccagagaccctccagtctctaatacctttgacttgaagagcagtcatttttttttccttttcttttcttttcttttttttttttttttttttgagatggcctcactcttgcccaggctagagcgcactcgtgtgctccatttacggctcactgcagccttgacctcccaggcacaggcgatcctcccacctcagcctccaaagtagcagggaccacaggtgtgcaccaccacacctagctaatattttttatggtttttatagagacagggtctccctatgttgcccaggctggtcttgaactcctggcctcaagtgatcctcccatcttggtctcccaaagtgctgggattacaggtgggagccaccaagcctagtcaacagtcacttttattctcacttcactggagaggaaggctcagaggctagtaagtggcccaggagcatgctggcagtgataaaacctgctggagtgacattttcccactggctctcaatcctggatatatattaagagtcagaggccaggcgcggtggctcacgcctgtaatcccagcactttgggaggccaaggcaggcggatcacgaggttaggagatcaagaccatcctggctaacacagtgaaaccccatctctactaaaaatacaaaaaaaattagctaggcgtggtggtgggtgcctgtaatcccagctgaggcaggagaatggcatgaacccgggaggcggagctgcagtgatccgagatcgtgccactgcactccagcctgggtgacagagcgagactcgtctcagaaaaaaaaaaaaaaaatgagggagaactttttacaatagcaacgggtgaacctcacccagaccaattaaatagaatcaccggagatgggtggctttaaaaaaaggtctccagaaggcctggcgcggcagatcacacctgttatcctagccctttgggaggccgaggtgggtggatcacttccagcctgaccaacatggcgaaaccctgtccactaaaaacaaaattatctgggtgtggtggcggacatctgtaatcccagctacttgggaggctgaagcaggagaattgcttgaactcgggaggcagaggttgcagtgagccgagatggctacactccagtctgggcaacaagcacgaaactccatctcaaaaaaaaaaaaaaaaaaaaaaaaaaaaaacagatttccagatgaccagtgtgcagcccgagccgagagtctgctttagaccagagctgctcagactgtaatgtgcatgcaagtcattgagggtcgagttaaaatgccagtagattcagtggctctggggtggggccccaggctgtgttgctatcaagcctccaggtggtaccactctactcactgcagaccccgtaggcagtgtggtcacttggtcaattgccatttaagactcactaggggccaggtgtggtggttcacgcctgtaatcctagcactttgggaggctgaggcaggcagattgcctgagctcaggagtttgagaccaccctggggtgaaaccccatctctactaaaatacaaaaaattagccaggcttggtggcatgtgcctgtaattccagctactcgggaggctgaggcacgagaattgcttgaacctgggaggtaggtggacgttgcagtgagccgagattgtgccacttcactccagcctgggctacagtctccaaaaaaaacaaaaaagagattcagtatatcagctactcacagttgaccctgaagatctctgggaagtagtgactcatgactcgtttatttattaagttttgctgtagcagaagtttacttttgagccaagagtctgatccggtctccctcttttttttttttttctttctttaaagagatggggccttgctatgttgcccaagctggtcttgaactcctggcctcaatccatcctcccaccttcggcctcccaaagtgttgggattacaggtgtgagccacctctctcaggcaagagcccctcttttaactagacaatgaacctggtttctgctttggacaggctatttagttcctgcttatttaccctcatggtgggagagaccctggtgggatttggggtgaaagctggctgtggttcttgcaggagcctcatgacacctgagggaggtgtgatcaggcaagactgggcctctacactgagagccgactagggcaggtctcagaagcagagactgaaggaagttgggtggatgagtggatctggggagcaggggccaagcctgagggctgggcagagccttccaaaggtcaacacaatccttgctattgtcttttgagggccctgatctattttaagtaaaatgctctaactgcgcatgtcatctggaaggaaaccacaaaaaactcaatctgagacttgtcaccaatgtgctgcctgagtcaaagggtttccctggctcacctccatagatggcgagggtagaaggcaagacctgtcctgggtggtctaggcagaaggcccaggtttagggcatggcaggtgggtggtcagggaggtgaggtggggtcctggtgctgatgcaggggcagttgccgagggcttggcctcagaacaaggcaggagtccagccatgaggatgactcttgctgagtcactgagctgggcgaggcattcagaccccctgactgggcccagctggggcggcagatggtggagaggcctcagctgtggggggtgttggggagattatccactgatgaaccaaatggaggctgttcccagagcctgcttccaaccttgcacggccttctagagttcaaatctttcctgggggggcctcagagccctgtccatacctccgctcacagccccagcccttcctcttctcccatctggtttcctggccaggtttcggccctgcggagaaccctccaagggagcagtggaaaaagcttcacttggcagtaaagcccctacttgctgttccatccctgcagctggggtgaaataagccactgaccagtaaacaactgaggcttaaaccagcatgccagctcaggtggggagcccccagcactggttatattccctagattcctcactggataggaaagttgggcctcaggcactcttccctcctctgcagtcaaacagtgcagatgaagagccaggctctgttcccagtgctttatgtgctaacttggttgataatgttatccattctcattttgtagatgaggaaacaggcacagggtggtcaagggacttgttcaaatcactgatcccataagggtgagagccaagatccaggcatcctggctgggtgcggtggctccacctgtagtcccagtgctttgggaagctaaggctggatgactacttaagaccaggattttgagaccagcctggacaacaaagaccttatgcctacaaaaaattaaaaattagctaggtgtggcagtacgtatctacagtcccagctactcgggaggctgagatgggaggatcccttgagctgaggagttcaaggctacagtgagctgtgatcactgcactccagcctgggcaacaaagtaagaccttatctcaaaaaaaaaaaaaaaaaaaggccgggcgtggtggctcacgcctgtaatcctagcactttgggaggccgaggcgggtggatcacaaggtcaagagatcaagaccatcctggtcaacatggtgaaaccccgtctctactaaaaaaaaaatacaaaaagttagctgggcatggtggcaggcgcttgtagtcccagctacttgggaggctgaggcaggagaatcatttgaactggggaggcggaggttgcggtgagccgagattgcgccactgcactccagcctggcgacagagtgagagtccatctcaaaaaaaaaaaaaaaaaaatccagatctaggcattcccagccctctggactctaggaagtcgtctttccagaacagagccccgtattgtggagcaactggggggtggaatcaaaggtgagcaggacagggctataggaagaaaagacaaggtccccataagagtggcgagaggaacagagccaggacatcggaaagcaagcccctgtgttcccaaaccgcagaagagggagctctgatgttagacaagccaccctcctacaagcgaagggaaagtaactttgagcaaaaatgagcaacagaaaatgagatcaaggtcagatctcatacaaagttgcaagatgaaagaatgagcagcagaataacctccctgtgatgtggaaagtgtgccaggaaaacagacccaaactgtaacctctttcagaatgaggcaaggcagtgaggaaactatgtgaaaacacgaaagcagccgatcagagttgtaagcccgggcagtctgggttggaatgggtgccccgagccacgggaccatgatgcctctctagaaagacaggaccaggcattccaccagggttctagtcccaacagcaccactaacttgcttgtggccctaaaggattcattgtccctctctgggtctcaactatttagagctctactgtccagtatgggatcaaccagccatatttggcaatttaaattaaaattagctgggtacggtagcgtacccctgtaatctcagcactttaggaggctgaagcgggaggattgcttgagcccaggagttcgagaccagcctaggcaacatagcaggaccttgtctctgcaaaaaaaatgaaaaaattagctaggcgtggtggcacatgcctgtaatcccagctactcgggaggctgaggtgggaggatcacttgagcctggaggttgaggctgcagtgagtcatgattgtgccactgcattcctgcctgggcaacagaacaagaccttgtctcaaaaaataatttaaaaatttagttcctcagatgcattagccacattttattttatttttttccaagacagagtcttgctctgtcgcccagggctgtagtgcaatggcgagatcttggctcactgcaacctctgcctcccaggttcaggcaattctcctgcctcagcctcccaaatagctgggattacaggcacgtgccaccatgcccagctaatttttgtatttttagtagagacagggtttctgcatgttggccaggctggtctcaaactcctgaccttgtgatctgccgacctcagcctcccaaagtgctgagattacaggtgtgagccagcatgaccggccattagccacattttaagtgttcaggagccacatgtggatgtggctagtccaaagacagcacagatttagaatattctcatcattgtagaaagctctattggacgctgctgagtaaaagggtttttttggtttggttttgagattggagtctcgctctgttgcccaggctggagtgcaatggcacgatctctgctcactgcaacctctgcctcccaggttcgagcaatcctcctgtctcagcccccctagtagctgggattataggtacccgccaccacaactggctaatttttgtatttttagtagagacggggtttcgccatgttggccaggctggtctcgaactcctgacctcaggtgatccacctgccttggcctcccaaagtgctgggattacaggcttgagccaccacgcccggccaagttaaagggtttttaaacaagagctgggcagtgcaatggcatagctgtaaggcagcagggggtggtggggactgtggtaggtgggaaagcttgtgttccatctaaatggggcagctgctgcttgactgtaggctgtattgctggtcttctaattcttcaagtgaatcaggaattgggattttgtgaagactcacaatttctaaacaaaaagttgaagttttacagatcgtggggctcaagtataactcctcttgggctgtatccagccttgattctgtaatctgtggctcctgcctgtttttcctcggccaggccactcccttcttcccctcacttatatttttcacctggggttggaggctgggtagatggtggaattgatgaggaaccacttttttttttttttttttgagatggagtctcactctgcctctcataatgctgggattacaggcatgagccactgcacctgtcctggccagacatttttgaggccaccaccagacaaaagaggctcctcatcggccaggtgtgatggctcgcctataatcccagcactttgggaggcagaggcaagaggattgcttgaggccaggaattcgagaccagcctaggcaacataatgagacctcatctctccaaaaaaaaaaattagctagacatggtggcatgtacctgtagtctcagctacccaggaggctgaggcatggcttttgtgagctatgattgcaccactgcactccagcctgggtgacagagtaagactccgtctcaaaaaaaaaaaaaaaaaaaaaaaagtctgacctgagtctcttaaggatgaggctctggagcacctagtaaacttggtcccatttgtgtgactcaaagggacatgtccaaagtccaaagtgctgggggcaggggtggggcttaggtagggcatgtgacattcctgaacaggccaagcactgggtgaaactactcaggattcagaagcaggtgggatgggtgggtggaacatgataatcatcccccttctccttcctttccaccctacccttgctcacaactgcaggagctgaggatgggagagaactggggacgagggggccagagtgatttgcagtgttagtaatgcagctggttctatggaaggctcagttccatctgggatccctttatgagcagtggactaggtcttcacattcagcccaggattactaaagcataggaaagaggcagggaacatagacacagctcatgtaaacattccttttgtttatggccgaatcctagccactggactacctgaggcatacagatattctttggctatgggctgacatttgaatacagctggggcctcaggattctctgaaataaagggctgcctccctctggaggagccaggcagctcctcagagcagctgcccattgcgtgctggacaaggccatgtcaccacctccatggctccccagtttcccagcttgctgtatctctccaccgtaagagactgggagcaccttgatctgaagctctttgcagtgccggtggcagtgtagggggaagtagttgatgggagtgagggaaaggaattggcaaggaaccctgggcctctgtggctcactgcatcaagcagttcttggcaaaggtaaggtcaggatgggctgtgtcgtcttgggtggggtgaagacagggagcagtgggcatgcagatgcggacagggaagggtgcagtggcctggctggaggaggtagggccgtatcccacccagagtctgtcaccagattcatgcctgccccaccccaggctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagaggtgggtgtgggggctgggctgtgggggatccttggggatgtgggggcctgtttggctggcatgatggtccttatcctcctccctcttcccaagcaggagtggccctcgcttgggcgatagagaggtttctctctcatttggtgtcctctttggtagtggagacctggtcccaggtcctcacacctcttctcatcttcctgcagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggtacctggtttcctcactccctatgccccaccctacctgtcctccacctgccttgggctctatactgctgccttcttcttctttttttcttttcttttttgaggcagagtttcactcttgtcgcccaggctggagtgcagtggcataatctcggctcactggaagctccacctgggttcaagtgattttcctgcctcagcttcctcagtagctgggattacaggcacccgccaccacgcccggctaatttttgtatttttagtagagacagggtttcaccatgttggccagtctgatctcaaactcccgaccccaggtgatccacctgcctcggcctcccaaagtgctgggattacaggcatgagccactgttcccggcctgtaccgagttctaaagggaaaacaaaccagggcagtgggaggggtggggagagacacttgctggctctcaccaagggtggaattgactcactgtacctccactcacctccagccacccccatcctccacacatgccccaaacacacctgcctcttttctgagaactgttggcccatctcaccttcccaggctccagagcctaccagaagtgcccagccagtctggcattaaatgacatgtgccaaggttaagcagttcattcacccggtgccagacactggtgggcagtgccaaagcagcagtgacaagcccaggccccaggctgtgcctgttctaggagaagccatcacaggcctgaacctacagccaggctcttgtccccgttggcctcaggcctgggcctgagcaggtgggtgtcccaccttcattcctttacctgttcttccacctttaccttctggccatttaatggttttgggttttttgtttgtttgtttgtttgtttttaatagagacggggtttcaccgtgttagccaggatggtcttgatctcctgacctcatgatccgcccgcctcggcctcccaaagtgctgggattacaggcatgagccaccgtgtccagccccatttaatggttttcttactgactttactaaccagtgctgcttgatcctgaaagcataatagcagaacatggggaacttttagagacattcatgtccacttaggtgcagacagtttgggggaagaagtgtgtgtgtagagagaaaatgaagaatgattaagacaataacccttaaggaatccaagtgaaaagtatatagggattcttgtacctttttttttttttttttttttttgagatggagtctcactctgttgcccaggctggagtacagtggcataatctcggctaactggaagctctgcctcccaggttcacgcaattctcctgcctcagcctcccgagtagctgggactacaggcgcccaccaccacacccggctaactttttgtgtttttagtagagatggggtttcaccgtgttagccagggtggtctcgatctcctgacgtcatgatccacctgccttggcctcccaaagtgctgggattacaggcgtgagccaccgcgcctggcctttttttttttttttttttctggatctccccctgttgcctagacgagagtgcagtggggtgatcatagctcactgcagcctcaacctcctgggctcaaacgatccttccacctcattctcccaaaatgctgggattgcaggtgtgagccaccaagccctgcctaagctttcattttaaatatgttcagccgggcacagtggctcacgcctgtaatcccagcactttgggaggccaaggtaggcagatcacttgaggtcaggagtttgagaccaggctggccaacatggcgaaaacccatctctactaaacatacaacaattagccaggcgtggtggcatgcgcctgtaatcccagctacttgggaggctgaggcatgagaattacttgaacctgggaggcggagattgcagtgagctgagattgcgccactgcgctccagcctgggtgacagagcaagactctgtctcaaaaaaaaaaaaaaaaattagctgggggtggtgacacacctgtaatcccagccactcaggaggctgagacagaaggatcacatgagcctgggagattgagactgttgtgagccatggttgtaccactgcagtccagcctggatgacataggaagaccccatctccaaaaataaaaaaaagccagctcttcctttgagccccagtttcagttcaaagggccttctctaacttctccttcatctgaactcctgagacagggtcttgctctgctgcccaggctgaagtgcagtggtgcagtcatagctcactgaagccttaacctcctgggctcaagtgatcctcccacctcagcctcccgagtagctgggactacaggtgtgcgccgccaccatgcctggctacactttttttttttttttttttttttagagatgggatcttgctatgttgcccaggctggttcttgaatgtctgaggtcaagcaatcctcctacctcagtctcccaaagttctgggatgacaggtgtgagccactgtgcccggcctccaccccagtcttatttcaggacatacagagatggatgttgtggacccgcctccagagcatcaggcttggccctggggtcacagcactgatggttctgtgtctccaccttcttccccactaggacatcacacccctgcaggtggttctgcccaacactgccctccatctaaaggcgctgcttgattttgaggataaagatggagacaaggtggtggcaggagatgagtggcttttcgagggacctggtaagttctgtctccatagggctccctgccttcctgtcatagccctgataccttctgaccatcaccttccctccccaggcacgtacatcccccggaaggaagtggaggtcgtggagatcattcaggccaccatcatcaggcagaaccaggctctgcggctcagggcccgcaaggagtgctgggaccgggacggcaaggagagggtgacaggtggggtcaccaaggggcgatgatggtgggtgggcaggaggggtccccactgcaggggaagcaggggaaggttgaggaaagcctcctgtagccccagagaggcgctttcctggtatcttttgaaagctgttgagggccacccactgctcttccttccccacccccgcttcatgctgtttccacttgggctggaaaatgtgaccatgaccatgcggatgtggcttttccttccctcaccttcaccatgagctgtgggcagtggccatgacttacctgattctggatcaacaaagaagatgttcaaatacaattgacaaatgtaggccaataggtacagtggctcacacctgtcatcccagcactttgccaaggtgggtgaatcgtctgagcccaggagcttaagaccagcctgagcaacacagtgagaccccatctctacagagaatttaaaaattagcctggccttggacacacacctgtggtcccagctactcagaaggctgaagggggagaatttcttgagcccaggatgtggaggctgcagtgagctgtgactgcaccactgcactccatcctgggccacagaggtactaccccgaggtgctaccattcccactttttttttttttttgagacggagtcttgctttcttgctgttgcccaggttggagtgcagtggcgcgatctcggctcactgcaagctccgcctcctgggttcacaccattctcctgcctcagcctcctgagtagctgggactacaggcgcccaccaccatgcccagctaattttttttttttttgtattttttttttttttttttttagtagagacagggtttcaccatgttagccagggtggtcttgatctcctgacctcgtgatccaccaggttcggcctcccaaagtgctgggattacaggcgtgaaccaccgcacccggccattcccactttctatatatcaaaactgggatgcagaatgcaggttgcttgccctggggtgtggccaggcagggcgaggctgggacctgcatccaggcactctggcttctccagtaaaccaaaggacatccacaactctaacagaggcagttctgctgcctgttttagcagaaggacaaaagttggtctttggagcttagagaaggcagaacaggctgttggcatagcagcaacttgggcatcttaggaggccaaggtgggcggatcacttgaggccaggagttccagactagcttgggcaacatggtgaaacaccatctctacaaaaaatacaaatattagccgggcgtggtggcacgtgcctgtaatcccagctactcaggaggctgaggcatgagaatcacttgaatccaggaggctgaggttgcagtgagctgagatcacagcctgggcaacagagggagactccgtctcaaaaaaaaaaaaaaaaaaaaaaaaacttttaaaattcaactggggtgggggtttggcctcaaaagaatgaataagaggaccgcagtcaggaacttgagcctggggtcagtgctatctttttgcctatgaaatctgtcaatcccctgtgtctaagctgtgggggaggggtaggtggggagcaggctggggggcccttgtcccttaccctccactcttggcccaggggaagaatggctggtcaccacagtaggggcgtacctcccagcggtgtttgaggaggttctggatttggtggacgccgtcatccttacggaaaaggttggtgctctgggggctgtggtttaagggacctggggctagggaaccctccgagtggcagagaatggtggtagaatggcatgagagtaaaagagaagcaataattttagggtcacttaaaaaaattcagagatcagattgcctgagtattctggatcatctgaagggttaaatagtctttctggggctgggcgcaatgactcacatctgtaatctcagcaatttggaaggctgaggcaggaggatcacttgaggccaggagtctgagaccagcctgggcaacacagtgagaactcatcgctacaaaaaatttaaaaattagctgggtgtagtggagcatgcctgtaattccagttactccagaggcgctgaggcaggagaatcgcttgaaccccagaggcagaggttacagtgagccatgatcatgccactgtgctccagcctgggcaacagagcgaaaccctgtctcaaaaaaaaaaaaaaaaaacaaagccggtcgggtgcagtggctcatgcctgtaatcctagcattttgggaggctgaggtgggaggatcacctgaggtcaggagttcaagacaaacctggccaacatggcgaaaccccatctctactaaaaatacaaaaattagctgggcatggtgtcacccacctgtaatcccagctgtactcaggaggctgaggcaggagaatcgcttgaacctaggaggcggaagttgcagtgagctgagatcgcacctttgcactctagcctgggcaacaagagagagactccgatttaaaaaaaaaaaaaaacaatccctggattggtagaaattgtctctgagatctgggagcattgggagcatttggtggccaatggggctcgcagatcccctgaagttggaggcaggtcactcaaatacccaacatgttgctctgcagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaaggtgaggtccctacacccccacagaggactgccctgggagatgtatgtcctctagtggcatgaggccctctgccttctctcctccagacgcacgttctaggaacaccttctgtgcctttgcatgcttagttcttacacacctgagacactggcccatttgattcctggcagcctctgacttacccctcagacctgaagttaattccccttctgggaaggcctcctggctacccgctgcctgagactctgaaactctgatacagtcatgcgccacttaatgatggggatacattctgagaaatagtccttagatgattttgtctttgtgcaaaagagtgcacttatgcaaacctagatggcacctagtctagatggcgtagcctgcccctaggctgccaacctgtgcagcatgtgactgtcctgaatactgcaggcagctgaacacaatggcaagtacttgtgtatctagccatagaaaaggtaaggtaaaaatacaatataaaagcttcgttataggccagcacagtggctcatacgtgtaatcccagcactttgggaggccgaggcaggtggatcacttgaggtcaggagttcgagactagcctggccaacgtggggaaaccctgtctctactaaaaatacaaaaattagccaggtgtggtggcacacacctgtaattccagttactcgggaggctgaggcacgagaatcacttgaaccctggagatcaagcctgtggtgagccgagatcgtgccactgcactctagcctgggcgatagagtgagactctcagaaaaaaaaaaaatctccattataatcttacgggaccaccatgtgcagtctgtaatggactgaactatcatgcagtgactatatttcacatctttaatatcctggtgttcactttgctttgtcatcttttgtaaaataaacctcttggtttaccctctcccaccccctacttcatcccctctctgaactatatgtgggaataccagcagttgccaaactcattctgtaaagggggctggatggtagatactccaggctccgtgagtcattgtttctgtggaagttcttcaactctgctgttatgtcaggaaagcagcttgggcactacgtaaacaagtgagtactgccatgctcctggaatagtttatctgcaaaaacaggaggcagaaaaagtagaaataggccaggcatggtggcttacatgtgtaatcccagcactttacgagtccaaagcgggtggatcgcttgaggtcaggagttagaaaccatcctggccaacatggcaaaaccctttctctactaaaaatacaaaaaaattagctgggcatggtgtcaggcacctgtaatcccagcttctctggaggctgaggcaggagaattgcttgaacccgggaggcggaggttgcagtgagccgagatcacaccactgcactccagcctgggtgacagagcaagactgtctcaaaaaaaaaaaaaaattagaaataacccaaatgtacatatataatgaatggataaaaaattgtagcatatccatacaatggaatatcattcagccataagaaagaaatggcaggccaggcgcaacagctcatgactataatcccagtgctttgggaggccgaggcaggaggattgcttgaagccaggagtttgagaccagcctgggtaacatagtgagaccccatttttacaaaaacttttaaaaattgaccaggcatggtggcacacctgtagtcccagctatttgggaggctaaagtgggaaaatcgcttgaccccaggaagtggagtgtatagtgagctatgattgtgccactgtactccagcctgaggcagtagagtgagatcctgtctctaggaaaaacaaaaaataatgacatacgtgctacaacatggataaaattgaaaatgttatgctaagtgaaagaagccagctggacgcagtggctcacgcctgtaatcctaacactttaggaggctgaggtgggcacatcacctgaggtcaggagttcaagaccagcctggccaacatggtgaagccccgtctctgttaaaatacaaaaattagctagcatgatggcgggtgcctgtaatcccagctactgctcgggaggctgagacaggagaatctcttgaacctggaagacagtagttgcagtgagccgagatcccaccactgcactccagcctgggctgctgagccgagactccatctcaaaaaaagaaaaagaaaaaagccagacatcaaagaccacatattgcatgattccatttatgtgaaatgtccagaataggtaaacacataaagaaaatagactagtggtgggtggggtaggtggggagtggcagtaacttctaggtacaggatttcttttcagggtgatgacgaaaatactctagacttaacatagcagtgatggttggacaactttgagtatactaaaacaactgaattgtgaattgtatactctagatgggaaaatttcatatgtggattatatctcaaaatttttttaagaaacaggcggtgctgggcgtggtggctcacatctataatcccagcactttggaaagctgaggtgggtagatcgcttgagtctaggactttgagaccagcttaggcagcatggcaacaccccatcatctacgaagcacacaaaaattagctgggtgtggtgatgcgcatctgtagtcccagctccttgggaggctgaggtgggaggattgcttgagcctggaaggttgaggctgcagagagctgagatcatgccactgcactatccagcctgggcaagagaggaagactatctcaaaaaaaaaaaaaaaaaaaaaaaaaggcagaatccagatttggcctgaaaaccagagtttgtcaagccctaggttacaccatctctagaaaacaaagcctgggagaaagaagaaaaaacaggttgatttttaatggtttagcttgcgtggatccaggtcctgacagttatggaatctttcaaggacacatttgaccagatgagatttggcaggcgtttgtgtagagcctcacagtccagacagtgcctcaccgtattatgatgtgggggtgggggcgggcttctggtgctcttgtcctccacacaggcctgaaacagcacaggactggggaggtaccattggaagcacccgcaaccctaaaggcactgaccctaacctcacgtctccccactagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtaatggctgggagtgagcagcagtgctgccacgtggccttggccttggtggcggcttcctctgggtgtgtggaagaggtgggcagggacttcagcagcatggagagccatatcaggtgggctgtctggttgggggagggcactacgtggagtgtttgccatccttctgccttaaatgtctcatttgaaatgttagaaccaaccaggtgcggtagctcacatctgtaatctcagcactttgggaggccgaggcgggcggatcacctgaggtcaggagttcaagactagcctggccaacatgggaaaccctgtctctactaaaagtacaaacattagtcaggcgtggtggtggtctgagtagtcccagatacttgggaggctgagacaggagaattgcttgaactgggaagcggaggttgcagtgagccgagatcacaccactgcacttcagccagggtgacagagtgagactctgtcaaaaaaaaatattagcatgtccactgagaggacaagtgggggtttaggacagggaccctttcccacagcagacctggtttccagcataaaggtctgatggggtggccagggaacaggaaggacctcctccctcatgcccatatcccggtggaatctttcatttttttctgcttcacctaaaaccttgaccttgatttgacctcgggccacatctccaaccttctctaagaatccaagctggaagtccagcttggaatccgagggagcatccgtgtacacagcctacttcaccatccccgaggtgccctccaaactgccccatgaaggaagattctagaaataacattgagcaccttctctatgccaagagctgtttgagctagacatgtgaagatgtcattcacccctagaccctgcaaggtagccaccgtcaagtccacttgacacatgaggaaactgaagcccaaggggtgaggtagttagcccacgatgacagggccagcagatggcaaacccggggtggagcctggcctccccgtagagaaggtgtttaacctcgtggcgcgccttccctggatgggctctgctttgggacagctgggcggatcttcctcccttccacccttacgggcagcttccctccctgtcctcgtcccaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccggtgagtgctggcagcgcagggtgtagggggtggctctccatgggtctggctctgaccctcggctgtctctgcagcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggtaaaaatggggacagggcatgggggtgcattcctggaatcccagcactttgggaggctgaggtgggaggatcacttgagcctaggaggtccaggctgcagtgagccttgatggccccactatactccagcctgggtgacagagcaagaccctgtttctttgttttttgtttttttagttttttggttttttggttttttggttttttttgagaccgagtttcactcttgttgcccaggctggagtgcaatggcgcgatcttggctcactgcaacccccacctcccggattcaagcgagtctcctgcctcaacctcccaagtggctaggattacaggcatgtgccaccatgcccagctagttttgtatttttagtagagatggggtttctccatgttggtcaggctggtctcgaactcctgacctcaggtgatccgcctgcctcggcttcccaaagtgctgggattacaggcatgagccactgcacccggtcaaccctgtttcaaaacaaaaaaaacaaaccgggtggcaagcagtgggtgagggttcctgctgggtgcagcctaggaaccccaagaaaaggagggtcctgctcaagtgctggtgctgggctcctcatgaaggcaggacacctcattcagtgctgaggtcaagagggaacctaggagttcacgcaaatccagggaaggcgtgggctcacctcctggggtcaggactcagggatccagtagcaggacactaccccaactaagctcccagtgagcgtgcagccaaatgcgtaactgtcgggctgttaaaagatgcatgggacacagctggcgggagtgggcagtgcaagggggcggtgagaactcaagttcagaaactgactgccctggcctgcgcccccgccctgctgtttgcagcctgtggacctggggaagggacagggtgctttcctcagtttccccatctgtaacatgaggaagacagcattttctccttcacaaggccattgaaaagatgcaatgagtgttagaacagtgcctctattggtcagagctcaatagcagctattaggattgggtgagataagtcatgtacagaaacagtgttcatgactgggtactgtggctcacacctgtgatcccagcactttgggaggctgtggcaggaggattgcttgaggccaggagtttgagaccaggctgggcaacataacaagactctgtttcaaaaaaaaaaaatttataaactagctgggcatggtggtacatgtctatagacccaactacttggaaggctgaggtgggaaaattgcctgagcccaggaatttgaggctgcagcaagctatgattgtgccaccacactccagcctggacaacagagacccacagagaccctgtctcggaggaagggaggaagggaggaagggaggaagggaggaagggaggaagggagggagggagggagggagggagggagggaggaagggaggaagggagggagggagggtcaggcgtggtggctcatgcctgtaatcacagcactttgggagactgaggcaggcagatcacttgaggtcaggagtttgagaccagcctggccaacatggtgaatccctgtctctactaaaaatacaaaaattagccaggcctggttgtgggcacctgtagtcccagcttgtagtcccagctactcaagaggctgaggcaggagaatctcttgaatccgggaggcggaggttgcagtgaacccagatcgagccactgcactccagcctgggcgacggagcaagactgtctccaaaaagaatattcaatactcccaagcatgtccctcacctcttagctgagagcagccagtgccctgatggcggcagacagctgccgacatattcccagggctgccgacatattcccaggcactacaacatcatagttaagagcacaggccccagaagcagctgcctggttcagctttctggcttgtcacatgttatatggcaagtcttgggccagccacttgacttccctggacctctacttcctcatctgtaaaatgggggtggtgatcattgccatctcatagggtggctgagtgggattaaaggagaacgtgtgttaagtttttaggaccttaccaggcatacattagcattctctattgcgagagaccctgcccggccacacaggatgggtgttgaagttcttctcggagagagttgctggctgggcgtgatcacacatgtagtcccagcactttgggaggctgaggttggggggttgcctgagcccaggagttcaagaccagcctgggcaacatggcaagaccttgtctcttctaaagagagattcctgggtgaaagcagcttccccattctgggcctgtttgttcacaggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagtaagtgaggctgggagctcggctgcctataatgcccatggcaggccactgctgggaactggataacctggcatcccttgtggactgcctgctgccatccctaccctcaaagatctattccctacccaacagatcaggtgacccacttaaaatgtgaatcaggctgggcgcggtggctcatgcccgtaatcccagcactgtgagaggctgaggcaggaagatcacttgaagccaggagtttgaggctgcagtgagccatgattgcgccactgcactccagcctgggcaacaggcctgggagactgaccctgtctcaaaagaaaaaaaaaaaaaaaagcacgtatcagatgtggctcctgcagcctcccatcttgcatgtgataaaacctaaactccttcctgcagctccagccggcctcccccgatttgccttctagcctcccccttccatgctcctcgtccctggaacatgttccagctgacatgttccagccccactggcttcctctgctccttcaatgcacagcttggacccacctgaaggccttttgcaatggctattcctgctgcccagaaagcttccccccgcccctgagctcccttccaggcaggcttctccttctggcttcagcccaaagatcccctccttggggaacacttttctttctctcacagctgaatagcaccctctttgcctggtctctcccacacttgtcactgtctgaaatcctccttgtatacttgttcttttcccactcaagtggcgtgaaagtagggggccgcagtcacgcctgcatttgtccggcctagaatgacactggcttgtggcgcgtataccattctgggttgagttgcgtattgggtgccttctaggggctggggtctgtcctgggcaccggtttggttggtggccgctgcccttggcgctcctgttcctgctctggccccatgccagcctctcacctgcgctccgtctcctccaggcatgaggctcagagactggagcaggaagcccgcggccggcttgagcggcagaagatcctggaccagtcagaagccgagaaagctcgcaaggaacttttggagctggaggctctgaggtgggttgagaactagaggaggagactggcaggggccgagggtcttaggacagcagctggtgtgggcagcaggcctgggtggggtgtcgatgagacagtgcacggctacagcataagccaaggccgtggggggactgggctgtctcccgggtcttacctgactctgccttctccccagcatggccgtggagagcaccgggactgccaaggcggaggccgagtcccgtgcggaggcagcccggattgagggagaagggtccgtgctgcaggccaagctaaaagcacaggccttggccattgaaacggtgagtggggggaggcattaagaagagggtggccttgagtcctggaaaaggcccattccctacagtccctgagactgtataggacaccaggtcccccaacataaagccctatccaagtactttgcatttgcaaagtcctttgccttgtaggattcattgactccattgctggaaggtaaggattagaacacccattttgcagctgggcgctcatgcactggccaccttggcacaagtgctgtgtatgcttcataggcattatcttatttaatgcttgaaatcccattaagaggccgggtgcagtggctcacgcctgtaatcctagcactttgggaggccgaggcgggtggatcacctgaggtcaggagttcaagaccagcttggccaacatggtgaaaccccatctctactgaaaatacaaaaaattagctgggtatggtggcatgtgtctgtaaccccaactacttggtaggctgaggcaggagaattgcttgaacccaggaggtgtggaggctgcggtgagctgaggttgtgccactacactccagcctgggcaacaagagtgaaactccatctcaaaaataaagtaaataaaaataaatgtaaaaagaggcctagtgtggtgcctcaggtctctaaccccagcactttggaaagctgagatgggaggatcatttgaggtcagttcgagaccagttcaagactagcctgggcaacatagcaagacctcatctctacaaaaacaaaattttttaattgactgggtgtggtggcacatgcctgtagtcccagctacccaggaggctgaggcaggaggatcctttgagccaggagttcaaggctgcagtgagtcctgatctgcattccagcctgggtcaaaaaataaagaatgattgatttttcctcttccaggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtgagagttggggaaggtgtgttggtttcaggaccaaccttgaaaccaggaaggcagagccaaggcggaaaacacaacatctggaaagattgtggggaagggaggggtgagtgacctgacccacgatgcagggacattcacacagtgtcacgctgcatcaacgtcaggcactgtactagacccagcagtgagccagagctccggaggagacaggaaatggatgggacgccagtctgacaggcatttccaaggcagtcaagcagggtggtcagatgcaggggaggtgacccttcaaaccagctgacttaaggagggtcactctgaagtggccagggtttgacgcccatctcaacttcctcctgttctcaccctccaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaacactt

SEQ ID NO: 1299 - DNA, 27646 bp, Homo sapiens; identical to SEQ ID NO: 1298

SEQ ID NO: 1300 - DNA, 9312 bp, Homo sapiens
gccggagagccggaaccggagtcgcagcggcggtaatagtgcgagactcctctaagtcaccgtccttagcgcgggaccgcggggttcgacgggagttagcgggggtgcggccaggccgttggacgccggggggtcctggggccgatgtgaggggaggcgggggtgggggagccgggccggctctagaatcgagttgtccgctccgagccccggacggacactgatccgcgggctcgtcttggcctttcccaggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccaggtgagctcgttggccctggggaagggaggccaagccgccgcccacgggttctggcctggggcaaacccaactgagaactttgggcttgcctcgttctggaagctttcccagagaggagcaggatggagccgctgccctcgaggaaaagctagcctgctcggggaagacagagtggataaagacacttaaagtttattagacgatgtgtttccagtggagtaagagtgttacataaagtacttaggaaactcaaggaaacaagtccatctgtcgggggacggaagcttgttggaggggggccgaactgtgggagaggcctcgaataaggaggtggtaaaagagtcagccaaaaaccaaaagtttaagacaggaaagttaaagaccctgtgatttataaaagtcttctaattacaacaacccttaaagattggtggtattgtactcattttacaggtgggaactttcatgttcaaagttacccacaagtaaggaatggggtctgaagccagctcttagtgtcctgtcctttttcaggccataatgcaaaaaggtggagttggatcattcacgttcagggtgggagcctgagaaatcgtagcaagtaagccagggtagaattaagcacgatagggaggccagttcagagttctgtgggaagtaggatgatgtagtggttaaggctctaggttttgcagtgtgagatggctctaggtttgaatctgaactctgccgctttctagctgtgttagtaatcttaagtgtctttatttgtaaagcagaattaatagtacttaataagatgattgtgaagattcagtgagttggtgctggagatgaggttagcacagtgttttggtacagcatacgtgcttgataatcaccaggtattctatttcttttggaagagggcaataatgagatgggctaaagccatcagggagggcttttgagtggaggtaggccttgaaggatgaagataatttggctagctgatggaggcagggccagtgagggaagggcattccaagcaggacgaatgtaacagtggaggccctgagatgcgtggggaacagtcaggggtttaattacctgcctcctctggggaactgtgtgattgtggcttctaccaggctggagaattgtggcagaagagcccacagaattaccctacgtttattgaacagtaaacattggcctttacagggccactatttggcctggcccggtactggcaaaaaacttctatccatctcttccccccagcaatcctatgaggttggaatcatttgctgcattttatcgaataggaagccatgactcgtagaggtctggtgacttaactgaggtcacccactgaggacgtggcagagctgggtcctgaatctgtggccctcaggctctttgcctggccctgcctcacatagactacctgcagccagacagggcctgtgaggggatgatgagcagggtcggcctctttttcgccacctgtctgtggcttttctcttttgccagctgaccagaccagccccatggtgtttttagttgtcccctttccctcagtcctgattggcatttttaggaacttaaacctgttgttgcctggcactattctttaacctcgaagtattgtctccctcacgggccctggatcagtgtggtggtgatggtagacaaagcttagatagcatgctggagtttgcagaatagcaggaagtcgtatattcagtctccatggctccttgcaacagcctaaggaatacgcagggtgggctgagtacttagccccatttcatagcagaggaaactgagcctttgagtagataatgtcttgcccaacatcacgcagctagtcggaggggaagttagttttgcatccaggtctttgactgtgctccgtggtcactgagagccaggcagaggcatttagattttgatgtggggtgtgaggcagcaggaagccatggaaggctgaggggtggagggtcctgcccagttgaaactgagtggaactaggaggtactaggccaaggcctgagttggccgctgttgtcccaggctcagtctgaagcagggccatctctgatacctggttatggcctcctggggacccatcagagacccaggctgaggctggtggtgtcaagagcaccagcttgcctagagggcacagacatgcagatgaaaccagtggaagcacagaggtccgcagtgtctgagctgaaattgctgctactagaaatattagcacagtaggagagctgagcttttgaatcaggtggtcttcagtatgaatctttgccttgtcacctagaagcaatatgaccctcgtcaagtcactttctgattttttgaagtgataatgacatgcagttgagagtccgggtatccgggcacagggcctgctgcgctggtagccgttactgcaggcaggtcctgatagggctggggaagtgctgcaagtggcagaactggggctggaatctgggcctgattcccaggccacactggggttgcgctggcactgaggggggctttgcagagagcacgggccctgcatgtgacctccctgggcttcaggttttcactcagggtctgtggaaggggctggcataaattctcaggaaattgggcttctgggttccaatttagccactctccagcttggtgaccttgaccctcccgcttttctgtaagctttggtttctttttttctttttttttttttttgagacagagttttgctgttgttgcccaggctggagtgccagtggcctgatcttggctcactgcaacctccacctcctaggttcaagtgattctcctacctcagcctcccaagtagctgggattacaggcacgcgccaccatgcccagctaatttttgtatatttactagagacggggtttcaccatgttggccaggatggtctcaatctcttgacctcatgatctgcctgccttggcttcccaaagtgctgggattacaggcatgagccaccgcgcccggcctagcttcggtttctttactgttacgtgaggctgaagagaacctccccagtctgttggaaaggtcactatgagcagttgatggggaaggatgttcagcacaagaagcagtgcaggtgggagagtccgggtactgatgtggcctcttggaccaccgccagtgctgccttctgttcccagaaagccagggcagacctccttcgtgctgcctctgccatacagagcaaggggcataagtgaatcctcctgtccactgagctcaggaaactcattctaagggaagagattggcagaaagaggggggccaggcgagttgggcctcccacatcagaatatcttgataaagagtcagaccccagagccaggcttccctggttcatatcccacctgtgtcactggcaccaagccagcctccttccctgcttcaatttcttcatctgtgtaccgggaatcatcatagtacctgcctgccaagctcttaataacatttgtggcacacagtatgagctcgaatgttcactgctgctattaccaggcaaaatttggaaatacagtgttgcttaaattgggtatctataggctgggtgcagtggctcacatctgtaatcccagcactttgggaggcaaaggtgggtagatcacttgaggtcaggagttcgagaccagcctgggcaacatagtgaaatctcgactctactaaaaatacaaaaattagctgggcgtggtggtacatgcttctaatcccagctactcgggaggttgaggcaggagaatcacttgacccaggaagcagaggtttgcagtgagcaaagatggcgccactgcactccagactgggcaatggagccagactctgtctcaaaaaaaaaaaaaaaaaaaaaaaattgggtgtcttacctggcaaagtgatttcatctcctgctcactcaagtagaagtagactgcactgcaaggagaaataaaaaatatttaagtcctcatagtcataaagaaatactgaacacatggcaagagcacctcacttttttttttttttttttgagatgaagtcttgctctgtcgcccaggctggagtgcagtggcgcgatcttagctcactgcagcccccacctcccaggttcaagcgattctcctgcctcagcctcccaagtagctgggattacaggcacgcgccaccacgcctggctaatttttgtatatttagtagagacagggtttcaccatgttagtcaggctggtctcaaactcctgacctcgtgatctgcccaccctggcatcccaaagtgctgggattacaggcatgagccaccgcacctggccaagagcgcatcactttgaaggcgcatccactgtgggcctgccctgggcacctacccttgtgtctggatagcctgggagaagggctctgtgattggccaagggtgacttaagctctgctgtggagaggatggggagacccgcctcccaggagtgagtcctggatgcggaagagggagcggcagggggagtcagggctggaaaagtcccagcctgctcagaaggcctggaacgctgggataagaggttggactttgtccttttggcagcagggggccacggaagggtgttgcatgctgaagggccgtggtcagcctgttttggggagactgtacgcttcactcctgccccctggagcttccaggactgcctcatatcctcccctccccccaaaaaaggtcaggaattgggctgggctggcctggctgtggtgaccctggtcttctcctgtctccagagagatcttggtagaggagagcaacgtgcagagggtggactcgccagtcacagtgagtacctgctgtccctgcagagccaggcctggtctttcaggcacatgaagtttcctcttcatcttgggggctctataagcccaaccctaagctcttttatctgtcctttccctcaccttcaacggagcactgctaaaagaagtgggggttgctgtgcacgttggctcacacctgtgatcccagcattttgggagggcaaggtgggcacatcacttgaggttaggagttcgagaccagcctggccaacatggtgaaaccgtttctactaaaaatacaaaaattagccacgcgtggtggcacgtgcctgtaatcccagctacttgggaggctgaggcaggagaatcgcttgaaccccagagttggagattgcagtgagctgagatcaggccactgcactccagcctgggtgacagagggagactccgtctcaaaaaaaaacaaaaaaaaacaaaaaaaacaggccgggcgcggcggctcacgcctgtaatcccagcactttgggaggccgaggcaggtggatcatgaggtcaggagatcgagaccatcctggctaacatggtgaaaccccatctctactaaaaatacaaaaaaattagccaggtgtggtggtggacacctgtagtcccagctactcgggaggctgaggcaggagaatgacgtgaacccaggaggcggagcttgcagtgagccgagatcgcgccaccgcactccaggctaggcgacagagtgagactccgtctaaaaaaaaaaaaaagaaaggaaagaaaagaaaggggttatgggaagggactttggatttgttagtggagattcttggccagggcagaaggactcctatttggcgagtgattctgctcacatatctccagggctctgtgttagtaacttgattctgggtactttgtggggagtagagagaggaaggggccgggacatctacctggaaggacttagttctagctcttgcctacagaatagttggtactcagcataggacagtgggtatggttccagaccagactgacttggggtgggagaggagaattttggtcctaggaagtagaagtgcagccaagagtgataaagctcactaaagcagcgggtgtttggagggtagtccctggcaactcccactgcttgagttccaaccccactcttcctgttccccaggtgtgcggcgacatccatggacaattctatgacctcaaagagctgttcagagtaagagtgtggccaacactgtgaaatgtaacggggggatgactggaagacccctgtaattgagggtgggagccttaatttggggcgtggagtgggggcaaggggccccaagttagatgggtggttgtggaagaagggcctccgctggacagaaacaggtagggggtaggggactgtttacgacagggcaaaactttctacttccccacaggtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggtgatggaccgattctgcttttgggggtggtcagagacttgatgggggttgaggccagcggggcagcattctgggaggggcagaggctcactgttgcgaatgtggcaggtcattgatgccactggtgggagaggcagtgtggggccagatgacaaagggcctgggtgccttgctagggacccggtctgtgtctggtaggtgaaagaagagccattaggttcatagttgagggaatgggtcagctttacattctctggaggggtcgtgtgggcctgggaggtggctgatgccacacgattcaggcaagaggtgccaggagtgtgctgggcagtggttgtgaggatggcaggctggcgggcacgaggaggtcagagagggatgtgtggagagaccgtctaggcgccagccctggcttggtggccacccccaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaaggtaagccagcccagggctccatgggacagggagaggaggggggcttcaggcctcagccccgtcctctttccctgctctcccctgtagatcttctgcgtgcacgggggcctctccccctccatccagaccctggatcagattcggacaatcgaccgaaagcaagaggtgcctcatgatgggcccatgtgtgacctcctctggtctgacccagaaggtgagggcatgtgggcaggggcaggcagggacagccaggaggggttgggaaagagagggagcagggctggtcttcactgtcactcgtcctccacctgccaaatggctggaaccctggaggaggagcagggaggcctgcatggcaggtgctttgagcacacagtggcttggggcatggcccagagggctgtggaggacaaccaagtcatggctccctgaagtgaaggggccttagaacatgacagcagcttcttcagaggtcagaaccccagaatggtagccccctgagacccctcattttgtgggttttccactagtgtagagcagagctgagatttaaagtcaggtcttctgaggaccagccagagttcctgttgtcacaggcacacacgcacaggcagcctctgctccagcgcagacacacacacacatacacatagcctctgctccatcacagccacacacacgcacacgaggcctctgctccatcacagccacacacatacagacacacacatgcagacacacacatgcagccgctgctccacagtcactccggacctccctgtgacaacacagggtgcccttctgtctctgggagtgcccctttcactcttatgtgctgtttggacggggattgtatgatcactgtgattatgagggggccccaggcattgggcgttctttctcctctggagcttatctgcccctacatttgctgtcctggtccccgccatcccacagaccatattcaggccccatgctctggtcccacgggcctctggtggacttggggaggggccaggctgctcaccctcaaggggcagcgctggcagccagagaagcctgaggacatccctctccatccctccctttccgcatcagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccggtgagccggctgggccgggctgggatgggcgggcatctgagccgagctgctcctgaccctgctgccccgccttccagctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatg

SEQ ID NO: 1301 - DNA, 3794 bp, Homo sapiens
gtaacgcgtggctcccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgaggtgagacccgggcagactgaggctgcgggtaggagtggaccgaccgacggctgacgccgggcggactgcacgggaatgcgggtgtctggagggctggtggtggtgctgggcgggctgaaccatcgggaggaggcgccagcccaccgaaggcgagggaagccccgggagaggggctgacaggggatcgaaggagataaccaggtcccccagaaaggggcgggagcgtcctcgccctaaacgcgcagcaagaaaacccgcaccgcctgggagcccagggaggaggggaggatgcagagggagtggaatgcgaatgtcgggtcctctgcccagtcggcctgtcggagtgctatttgcacagctcgttgattttggggtgctgggatctgagagtctggatcttgttggatggacccagggagagaccctggagaaggtcctgtttacaaaagggttaatcttccccagggctctccaagcagaagactttgagtagagcactcctcccgcagggatgtcccaccctaaggcaaaggaaaccccaacttttcttcctctccctagaggcagtgcaaggctggccctgagacaggaatgtggcccaattgggcctgcagtgctgagcgccctcttccctcctcaccccaagcctatctcctcctcttccagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatggtgagccccatgggaccctagcccaggcctgctgtggctcccagcttcccgccagcgctgcaatagagcctctggagtaatcatgccttccttcccctctcctctctgcatggatcccacctccccaattccagggcctttgtttgcctctccctaggacctaaccctctgagccaccactgccctgcccctttgggtgggagggatatggaaacacgtgtcacacagcctcgctgacctgtgccctcctccccctgccccttcactcctccttcctcccttacccgccatctatggggctggcctctctctcttctggatgacttttccacctgatcccttctgggctggcttctcctgaccccggctatgtgcctccacccctcgccctaaccccagtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgaga

SEQ ID NO: 1302 - DNA, 28101 bp, Homo sapiens
ttacaagtggcgattttctgtttattgctcaaaaacaagaattcagaagcaaaggtggagagactgtgggttggggagatggcaggaagggggcaaggccttgtcccagctctcccctttgtccttcttctgaccctcctggccggagtcaggcctagggccagggcatctgggaggggggcaccttcgtggccaagggaacagtagagctatcgggggcagtccttgaggggtgccctgggcaggaggggctgcaagatttgcagggaggcagagttcccctcccagaatccaaaagccggtagggcggggggcaggcccctcgtttggcaactgagaagaggcggctttgggcggcaggatgctggtttatttactgtaggatctccagggccatcaaagccccctcgtgggatagggagactatttacacagccagggaggagggcagccaggaggcagagaccgggtcccgtatttccctctgcccgaatgaggaggggaggggcgtcctgggtcctgcagctgtagtcttggggttcagatggaaacttcatactcccgcgtatcctgaagacagagagatcaggtcagttgttggagtctgataggggtggaagaggcagccgaatgggaggaggggcaacgatcctgggttttaaagtaacattgacctctaggggctggggggccagtgaatgtgtttggttcatcctacggtgtcgtaaaatgacacaaaaatctgaatttctggcttgtcttgaataattggaagatctgccaattgtgcctcagtttcgactatggggtagagccgtattcttgagatggggcacaagtcctccacttagccacagtcctcaccactccctattgtatacacatggcttgctatgctcattgacatggcctctgggggcagctgagtttgaaattcccaagacagagattccagagaccttgcgagaaggttatggagtcctgggagagccaagtggtggctcttcaggggcaggcaaggtgcttaccccagcttcatacagcgggttgctgaagtccgactccacggtgatggggctgtaggagtgggagcccgagaagccgaaaagggactttccctgaagcctgggaaagggagaggacagaggagcttatcaacaggtaagcccctgagctcccctgacccaggctccagtgccaggctcgcaagacgtctgccctggccggcagtccccaagcaggctacttacttggtgtagtagatgtaaacgccactgccgaggacaatgaccaagcctagaggcagcaggatggccagggccaggttccccccttccagctgccgtgatggatctgtggtctgggtcactacaggaggaggagaggccggtgagctgtggctgggcccggtcctgggctctcccagcctcctgccctgggcctcaaaccctgggcttcatccctccaaggcctggcctcctgccccagcctctgccttgccctcccaacctggccagcctgggtctccacctgtgctctcactgaccttccagttttcggttgtccaggagctcctcataggcaactgcagggagaggagggggaggggatggggtctgagccagggaggggaggaggctgggaggggccgggagcccggtggggctgggctggacagcctggttctctctgccctctgctcaacctcaactttctccctttgtggggaagagagaggagtgaccagcacagggcctttgtcctctttctccagacccctaaaaagtcagggttcctggacagtctgagccaaactagaacttgtcagcgatagggaaactgaggcctattcagagcaagggacttccaagccaaggccccctctactacacccctgagccaatcccatgacctcacacgacccagggcttctggacacacccgtgaggacacgaggccacaggaggagaaccgggagctctgtggggtcgcccattggtctcaaatgtgctacctgactctcccagccctgtcacttcccggacactggtgtgcccctcctgccctgtctggccaggcacctttgcagagtgggggctggctggtccactgggaggggtggccgggcacacaggtgatggtgacctcgccgataagctcaaagccctcatagcagaagaagcgcagagactcgcccgcctggtagtggtgcttgtacagcgtctggtagccattctcgggaacccccgggttcaggcacggctcgtacttcactgcggggagcatgccagtcacgtgccagctgcactactgtgcacggggcagacgggctctcccagggctacccagccaccctcccagggtgtgccccagactcacaggcgcatttggggaccctatcgctccacttgggtgtgcctgtgtcccggctgtagcaggtgagcatggctgccccctcgaggctgtaccctggcaggcagcggtactggacgtgggagccaacggggaagccggcgtccgaggcggtgcggtgcccgttggcaatctcgccagggtcagcacaagtcatgactggtggcagaagaacaaggtcagggggagcgagggccttcaaagatcagcctgggcaacacagagagaccccatctctacaaaaaattgaaaaattagccaggagtggtggcgcactcctgtggttccagctactcaggagttggaggcgggatgatcgctcgaacccagcaggtcgaggctgcagtgaatggtgaccacgctactgcactccagcctgggtgacagagtgagacccagtctaaaaaaaataaaagaaaatctcccagaagcttagggctgggagaggcctgagcctcaggctgtttcctctgaacacctctgcacacacacgcacttcccaccaattcctcagaaggaagagagcatgaattggaaaaacttaaaatgcagtgcatctattttcaggccagaatgacaggcttaatttttttcaaaattcaacgtatgttatatttcaggcttcgtttagtaaacagtttgcttggggaaaccccaagcccctatcctggggtgaaattcaaaatatttaaccaccataccagagcatactagccaaatcccagcagggtgagcccaacatggcttgtagtctgtggaacagcagctgccctctttagagggggcccagctctcctgtccccagtattctcattatgcccagcccagttcactcacatacactccctgccttcaggcgtttgagtttacaaccctgttgtgaaggaatcataatcatagccatttcttgtatataagcctgagctacgtaccctgctaaatgttttacaaacaaatataattctttgtgtgtgtgcttgttttttttttttttttttttttttttttttttttttttgagatgggagtctcgctctgtcgcccaggctggagtgcagtggcgcatctcggctcactgcaacctctgccttctggactcaagagattctcctgcctcagcctcccgagtagctgcgattacaggcattcgctaccatgcccagctaatttttgtatttttagtatagacagggtttcgccatgttggccaggctggtctcgaactcctgacctcaggtgatccacccacctcagcctccaccagtgctgggattacaggtgtgagccaccacggctggccccaaatataattctttgttttggagacgagaacttgctctgtcactcaagctggaatgcagtggtgagatcacggctcactgcagcctcaaactcctgggcttaagcaattctcgcaccacagccttctgagtagctgggactacaggcatataccaccatgcctggctatattttttattatttgtagagacagggtctcactatgttgcccaggctgttctcaatctcctgggctcaagtgatcctcccaccttggccttccaaagcactgcaatttcagatgtgagccaccacacctggcacaaacataatatttaatcctgattatcctgagaggccaatgtcactgtcatctcccttggagcccagggctcagggcggtcaaaggacttggcccatggtcattcagccagggagtggcagagccggaatctgcccagggtcacagccatggagcactggacagggactcagatatgtgggtcctggcacaccttcaggctcaatctgctgccttgggcaggttccctcctgagcccgaggcagcggggccagccgaactctcagccccatccaggcctgatatcctgtgaatccttccaggggcgggaagctttgtccagcccaaatctggctacctgaagcttctccccttggtcccaccattgcttccagatgccacatggaactacagccccatgtccttggggctggcttcctaaaatttggagaaagtaaccagctgccattcctttctgctcttcaattttctttttctttctttctttctttcttttttttttttttgagatggagtatcactcccgtggcgcaggatggaatgcaatggcacaatctcagcttactgcaacctccacctcccaggttcaagcgattctccttcctcagcctcctgagtatctgggattacaggcgtatgccaccatgcccagatagttttttatttttagtagagacggggtttcaccatgttggccaggctggtctcgaactccagacctcaggtgatccaccgcacctggccctttctgctcttctaaaagatacacactcccagctcctttaaatgtcacctcctctgtgaaatctcctgccccagccctgagaaaattagcccactgctctccccacagcacttcgccacgcccagggcagcatgcgccctgtgaactttccatctgctcttcacaacctcagtcctacttcgccgatggggaaaccaagcctcagaaatgctaagtgcctcgcccaaagtcacccagtgatcaccaccctgcgtatccctcccagactgcgagctccataagagtatggaggggcttgaacccccttcgcctaaccccaacccagcacggggcttcaatgatggcattcaaataaaccaagtgctctgacaagccttggtcctagcaaagtggctccctacaatttcaactgataggactgcgggattggggcggggcgtaggacaggaaggtggagccaagtgtggacccggggagcccagtgggaacctggtcggagcccttttaggggccaaactcagatgccgcagaggaggggtcaggaggggacggggcggggccgtgagacgaggaaacagggaccgagcccaggtcggtgcaagaaagagggatgcagcccggagaagatgagagggagacccagaggggacagtttcggggaaccgggcggaggagtgagaactaaagggcatgggggcaggccttgaagaagatccaggaaggaccccgagcgaagggatggaacccagaaagcacgggggtcgggacaggacaggccgacgacggggcccacagggaaggggcggggccgaggggacgcgggcggggccggctcactcttttggcaggcgggcggcgcggcgctccaagacaggtcccactggcaagtgagaatgtcggagcctagcagctcgtagccaggctcgcactggtaggtgagcaccgtgccccggatcaggtccccgtgggatgccgttctccagccccactccggaggtggcagctcggggcacgtgtcgttcctcgggacctctgcaggggagggaaggcgagtttggaggctgcgttttaactgcgggctcccttccagcctcggaggctttgctctgtgccccctcccgggatctgtctctctctctctctcttagagacagggtttcctgtcgcccaggctggagtacagtggtacaagcatagctcactgcagcctcaacctcctggcttcaaacgatcctcccgcctcggcctcccaaggccccgggataacaggcgtgagccaccacgaccggccacctcccgggatctctggcctgcccgacccctgcccatcccgggactctatccctcagtacctttgaagtgcaatacgaagccctggcccaggcctggatttgggggcccgggcggtgcctgaaactgcagtgtgaggtcgggcccagaggagagaaggcggcggcgcggctgaggtccccgcagctgggccaagactcgggcgctgggaccgtccccgtcgaacagcgtcagcatgtccccttcccgcacattcaatctgcagggggtgagaccaggcaatggggcggggctgcgactggcccctcccatccagctctgccccatcctcaactctgctcattggtagcccctcctactctccagccccgcccatattctcctatcccaggtctggcgccgcctccgttttgaccaaccatggtttctcctatgctagtgcctcagggttcccctattctatggctcctcccatgtcctactacccaatccctaagcttgcacattactaactccgcccactgtccactccctcctccatcaccatgagatccacagcctagcccaactccagctctggccaatcacagaccaaattcgctaacgccctacacaactctaggccccgcctgagtacctgctttgaagccacgcccacttcagcttctgtgccatctcatgacactctcataccaattcagctcactggattctccccagacctccccaacttgctggtgttaacgcaacagtttgggtctgtgtccgtggaaatagctccaggggaagcctcagaaacctccaaagagtgagaggcaccaggccagagccccttgttcacagtggcccctaaggaaggctgcattgccctatttatttgtccgaggttgcctggctaatatgtgatttgagcccagctctctcacgtctatcctgtacccttagtgcaccagcctatccaccgaattctggatagatacgcaagagccagacaggctcagaatgcaggctactgcattggcataccacactttgctgagcctacacccgtcgcaccctctgcaggacccaaacatacatctcaacttggagcaagatgcgcttctcttcctggacgtgcacgccccacacgcagtcttggcccgggctatagctctggggccagtcgggagagaggaccacgccagctggttccgacagctcccctccacacatggctagggaaaaaggggtgtcaggttcaggacccaggtgggcatgctgtcttcatttctccacagtcctcaccactcgtgatgcgtgcaccacatcacctcgcttgtttcctattacctatgatccacctgtttcttttattcttttattttatttatttatttatttttaaattttttttgagacggagtctctctgtcgcccaggctggagtgcagtggtgcgatcttggttcactgcaagctctgcctccctggttcacgccattctcctgcctcagcctcccgagtagctgggactacaggcgccgccaccacaccctatttttttttcttttttctttttttttttttttgtatttttagtagagacggggttttacggtgttagccagaatggtctcgatctcctgacctcgtgatctgcccgccttggcctcccaaagtgctgggattacaggcgtgagccaccaggtccagcccctatttttatttttttagacagagtctcactctgtcgcccaggctggagtgcagtggcgcaatcccggctcactgcaatctccacctcgcagactcaagcgattctcgtgcctcagcctcccaagtagctgggattacaggcacgcactaccatgcccggctaatttttgtatttttagtagagacggggtttcactctattgaccaggctggtctccaactcctgacctcaggtgatccgcctgcctgagcctcccagagtgttgggattacaggcgtgagacactgctcccggctttatccacctgtttcttttttctttctttctttcttttttgagacggagtttcacacttcttgcccaggctggagtgcagtgctgcgatctcggctcaccgcaacctccgcctcccgggttcaagcgattctcctgcctcagcctcctgagtagctgggattacaggcatgcatcaccatgcccagctaattttgtattttaagtagagacagggtttctccatgttgatcaggctggtctcgaactcccgacctcaggtgatccgcccgcctcagcctcccatagtgctggtattacaggcgtgagccaccgtgcccagccatgatctacctgtttcttgccgcatctaggtcctgttgtgttcaatatccagtcctgctcttaacaaaccctgcccactctccagcctgcccaatctgtgacttaacccaacagcagttctcgctcttgaagacatttgggtttgtgacccctgcattcagtaacaagcccagcagttattcagctaagaaaacagcctctgaagggacagggatttacccaaggcttgggtggatgaagtctggatgtgcagccttcctttctgaacggccttgctgggatccccagttcagggggcaacgtggactgaaggacatgcctgcgacaaggaaggctcacctttgcaggccggctctgtgtcgttccagtggggttctgtgggatccacacattcgatggcattggggggcccagggggctccagggcatatcctgggaggcacgagaaggttgccagtgcccctgggcgatactcagggtccgtggtagtgacatttccatgtgccaggaagggggcgaagcagcgatcctcctcaaaggctgggaaggagtcagtcataacaattaagcattaggacaggcctcaagggatcttaaattggggatgtgggctgaattggggtgttctttggccactcactgggcttttttttttttttaaacagtcttgtgctgtcgcccaggctggagtgcagtggtacaaccttggctcactgcagcctctgacttccaggttcaagcaattctcatgcctcagcctcccaggtagctgggattgcaggcgtgcaccaccatgcccagctattttttttttttttgagatggaatttcacacttgttgcccaggctggagtgcaatggcacaatcttggctcaccgcaacctccgcctcctgggttcaagcgattctcctgcctcctgagtagctgggattataggcatgtgctactacgcctggctaattttttgtatttttagtagagacggggtttctccaggttgatcaggctggtctcaaactcccgacctcaggtgatctgcctgcctcggcctcccaaagtgctgggattacaggcatgagccaccgtgcctggccaatttttgtattcttagtagagacaggggtttcaccatgtcggctaggctggtcttgaactcctggcctcgagtgatctgcctgcctcagcctcccaaaatgctgggattacagacatgagtcactgcgcccagcctgggtttttttttaatttttttagagacagggtctcactctgttgcccaggctggagtgcagtggtgtgatcacagctcattgcagcctagatcttctaggctcaagtgatcctcccacctcagcctctctggtagctgggactacaagcatgcacaccccacccagcagctcattttctgattttttttttttttctgtagagatggagtttcaccatgttacttaggctggtctcgaactcctgacctcaggtgatccgctggcctcggcctcccaaagtgctgggattacaggtatgagccattgccctggcgttggtgggtttttaaaaactgaatgccactgggtttagcattcactctccagactgtcaaaaaaagttctaacactcctcattcacatatttatattgcctccctggcctctggagggaagccactgagctagccaaatcccagccaccattctacagagcggaggtccatagaccaaaaagccacttgctcaaggtcacacaaaagacaatggcaaaagcaggtctcaaacccagatggtttgattcccagccacagatacttggctctggaaacagcagagatagcgggtaaggggaggggtgccttcagagaactggctggtgtaggtgtattgtctcctcagaaataacagttggattctgatcatccatgctgttgctgaaacccaaaatttcagctaatgcaaaaactactcagtttttacttcaagtcagcaaaagtgaacatttgtagagcatttgagtttctgcccacctgatcggatcttagctgcaaaactccctgtaagttaagatttaggtgcctatgataccaatgaggaattcttttttttttttttttttttttttgggatggagtttcgctcttgttgcccaggctggagtgcaatggtgtgatctcggctcactgcaacctctgcctcccaggttcaagtgattctcctgcctcagcctcccgagtagctgggattacaggcacccacaaccacccccggctaatttttgtatttttttagtagagatggggttttaccatgttggccaggctggtctcgaacacctgacctcaggtgatccacccgcctcagcctcccaaagtgctgggattataggcgtgagccaccatacccggccttttttttttttttttgagatttttaattttattttaatattttatttttttattttttgagactgagtctcgctctgtcgcccaggctggagtgcagtggcatgatctcacttcactgcaaactcggcttcccaggttcaagccattctcatgtctcagcctcctgagtagctgggattacaggcacgtactaccacacctggctaatttctgtgtttttagtagaaatggggctttgccatgttgcctaggctggtttcaaactcctgggctcaagtgatccacctgcctcagcctcccaaaatgcggagattacaggcatgagccactgtgcccgggttattttatttatttttaaaaatgaggccagatgcagtggctcacacctgtaatccccccactttgggaggctgaggcaggtgaatcacctgaggtcaggagtttgagaccagcctgaccaccatggtgaaactccgtctctactaaaaacacaaaaattagctgggcgtggtggtacatgcctgtaatcccagctactcagaaggctgaggcaggagaaccacttgaacccggaaggcggaggttgcagtgagccgagattgcgccattgcactccagcctgggtgacaagagcgaaactccatctcaaaaaaaaaaaaaaaaggaaaaaaatgagacagggccttgctctgtcacctaggctggagcgtgcaatggtgggatcacaactcacagcagccttgacctcctgagctcaagcgatcctcctgcctcagcctcccaagcagctgggaccacaagtgtgcaccaccacacctggctaattttttgttttgttttgttttgtagagacaaaggtcttgctatgttgcccaggctggtctccaactcccaggctcaagtgatcctcccatcttaacctcccaaagtgctgggattacaggcgttagccattgtgcctggccacagtgaagaatcttaaactcatagaatagcagtggcctacaactctggagtcaggactcacaacttgctattttcggtaaaagatctgtgctgtttgcactttaacactcccagaatctatcccgcaattcatttttgcagatccactgttctatttcactgttacttaacctgcaaggtatcatgtccaaatcctacccatccatcacagccgagtgccaattccatttctcccatgattcatatcaaacactagaccctcctatctctaagcatttcatctttttggtctctctcttgctactgtttatacaactcctctgtttcagccacaatgaaattctgtttcccagacataccaggcatttccctacttgctgtttctcaaagttcctctctttccttttcttttcttttcttctttttttttgacagggtcttgctctgttgcccaggctggagcacagtggtgcaatcatagctcactgcaacctctggggttcaagtggggttcaagtgatcctcccacctcaaccttccatgtagctgggactagaggtgtgtgccaccacacctggataattattacttttttttaatttgtagacacaggatctcactatgttgctcagactggttctcaaactcctggcctcaaacaatcatcccaccttggcctcccaaagtactgggattagagacacgagtcaccacaactggcctcaatcttcctcttttaaaatatcctctgttggctgggcagggtggctcacgcctgtaatcctagcactttgagaggccgaggtgggaggatcacttcagctcagtagttggagaccagcctgggcaacatagtgagatgctgtctctacaaaaaatgtaaaaattacccaggcatggtgccgaacgcttgtggtcccagctactagggaggctgaggcaggaggatcacttgagcccaggaggttgaggttgcagtgaaccatgatcgggccaccgcactacggcctgggcgacaaagcaagacctatttcaataataataataataataataaaataccctctatcctttaaggccaaggtgaaatgcctcttcctccatgatcacttccttgtttctaccccttcacattcattcctcttcttctggtaacggcatcccaattttaattttgggacgcaggccttccccactcccagtccactaggttaagttggagcccaccagggaaggccacgtgaggcagattagccaatcccaatactcccttctcctagctcagtgattggctcaggctaaggccaaccaggatcttagtcaggtcaatgaacgcctctcctggcatttttgctgagctctcaggaaatatatgagtgttctctctgatgaggttactcggttggtggtatgggctggaggaggtggcttacacctgtaatcctggcactttgggagtcccacatgggcgaatcacttgagcccaggagttcaagaccagcctgggcaacatggtgaaaccccgtctctactaaaaacccaaaaattagctgggcgtggtgatgcatgcctgtaatcccagctactcgggaggctaaggaatgagaatcgcttgaacctggaggaggggggctgcagtgagctgagatcgcgccactgcactccagcctgggcgacagagaggaactctgtctcaaaataaataaataaataaaaataaataaaaactaaaaactgtcaggcgcagtggctcacgcctgtaatcccaacactttgggaggcggaggcgggcagatcacctgagttcgggagttccagaccagcctgaccaacgtggagaaaccccatttttactaaaaatacaaaattagctgggcatggtggcgcatgcctgtaatcccagctactcgggaggctgaggcaggaaaatcgcttgaacccgggaggcagaggttgcggtgagccgagatcatgacattgcaccccagcctgggcaacaagagcaaaactccgtctcaaaataaataaaggccgggcgcggtggctcactcctgtaatcccagcactttgggcggccgaggcaggcggatcacaaggtcaggagatcgagtccatcttggctaacacggtgaaaccccgtctctactaaaaatacaaaaaaattagtcgggcgcggtggcgggtgcctgtagccccagctactcgggaggctgaggcaggagaatggcgtgaacccggaaggcggagcttgcagtgagccaagatggcgccactgcattccagcctgggtgacagagcgagactcgtctcaaaaaataaataaataaataaataaaataaaaattaagttggtggtatgtaagtcggcagctatgtccatcacacagggaaagtgcctaaggatgaagccagcacagaggaaagaaccgagatactgagataactggtctctgggctatgtacctggatccagacattcatgaagcttaaacagagaaggctgcctgggggaaggagaaggggtccctagaagagatccttgcagttttggggcagggaagcgagtcacgtttcaaggaacccagcacggagatgaacaggcatagagtttgtgcttccgactatgcttggtgtcaggaagaggggaaggtgtggcggttggggtcctgtgggggagtgggtcacttaccttcaaatcgaaggcttaacagcaggggattggcaggtgtctctgacagcagctccacgtagagggactgggcgtcactgatgagaccccgctcggggacatcgtccatgtccgaatcatagatcacgggggatagggggctgccccctgagcgcaccatcagcctgggatggacagaaacgtgaccaggagctcaatctccctcacaagctgcctcaccccttgcctgctttcctaacttatttttatagctgttatcatcacacataactatatgccacgcactcttctaagcccttacacattctatctcatttaattttcacaagaactcttgagtcagacactattattatcctttattttatagatgaggatattagggcatagaaagatcaagtaacctgtccaaggtcacagagcaagtagtggcagggctgagataccaagttgctaggtaaaggatgataatgatgatgaagatagcagatgcttgaccaggcatggtggctcagctcacacctgtcatcccagcactttgggaagccaagacgggtggatcacctgaagtcaaggagttcaagaccaggctggccaacatggtaaaaccccatgtttactaaaaatacaaaaattagccaggcatggtggtgcatgcctataatcccagctactcaggaggctgaggcaggagaattgcttgcatctgggaggtggaggttgcagtgagctgaatccgtgccactgcactccagcctgggtgacagagcgaaagtctgtctccaaaaataaataaatagataaataaggccaggtgcagtggttcatgcctgtaatcctagcactttgggaggctgaggtgggtggatcacgaggtcaggagatcgagaccatcctggctaacacggtgaaaccccaactctactaaaaaaaaaagtacaaaaaattagccggacgtggtggcacacgcttgtagtcccagctactcgggaggctaaggcaggagaatagcttgagcctgggagacagaggttgtagtgagccgagatcgcaccactgcactccagcctgggcgacagggtgagactccatcttaaaaaaaaaaaaaaaagaggatagcagacacttttatagtgcttattgtcccaggtgccattctaaggactttatataatttcagcacttatcctcacagaaacctgaagagggaagtattgttatctccattctacagatgaggaaactgaggcacaaagaagttaagtgatttgtctaaggtttcacagctacacttcctaagaaagtcttaggactggctgggtgtggtggctcacgcctataattccagcactttgggaggccaaggtgggcagatcacctgaggttgggagtttgagaccagcctgaccaacatggagaaactccatctctactaaaaatgcaaaattagctgggcatggtggtgcatgcctgtaatcccaactaatcaggaggctgaggcaggagaatcacttgaacccgggaggcagaggttgcggtaagccaagactgcggcactgcactccagcctgggcaacaagagtgaaactctgtctcaaaaaaagaaaaaaaaaaaaaaaaaggcttaggactaagctgtgatgcatatctcaaccaggatccaccccagctgtgtccaagtccccacttagcctccctacttccctgaggtggggacttctttttttttttttgagacggagtctcattctgtctcccaggatggagtgcagtggtgcgatcttggctcactgcaagctctgcctcccgggttcacgccattctcctgcctcagcctcccgagtagctgggactacaggtgcccaccaccatgcccggctaattttttttttttttttttgtatttttagtagagatggggtttcaccgtgttagccaggatggactcgatctcctgaccttgtgatccgcctgcttcggcctcccaaagtactgggattacaggcatgagccaccatgcccggccaaggtggggacttctgacccaagacccagacccttaccggtcattgtcctcatccagcgagaccctttcaaagtgcaggtgcagccggcgcccctcagctgcttcaatgacccaacggcaggtgaggttgggccctacggctcccccaggctctggggacacgatgcggcccagggtggcattgtggatggtgccaccacaggatgctgtgggcagaggaggggtacgttaaggccagcctgaggtgaactgtccttctcctcggggcctcggcccgttttcagaactgttgcattcacacatttggctgggacccggcccagggctggcctctgtcccatggagtcactccagaggatgggaccttctccaggcatgagccaggaaagaaaccagccccggtacgggagaaccccaggattgacacctcctaggatggagacaccactaaaatgaagactctccaactgcggatactctaggatggggagttacaaggatccctaaaattcaaagcctcagctgggaaatcttcaggacaggactttcagagtgaagacaccacgggatgggaatcccagtaagaggctctctaggatagaagccctctggacatgaaccctaaaaatggcttcctctaggatgaggacgctaccccagaagggacctccagaatggtgactcccaaaataaaatctccagtgggacaccccgagatggagaccacccaaggatggagaaaccccaaggagagagaccctccgcacaaagagctctggctgcagaccccaggatggggactcctcagggtaaacaccccttcagaatgggttttccccaaaggtggacacctggacacccccgagataggaccctcccaatggggttcccagaacagatgccccacccactgtggcaggagactcacccatgcagctgggggtttcaccgttccaggatggccgggtgccattgaggcagatgagggtctcctctccctgcagctggtagcccgaatcacagtgaaaggtggcagtgcccccagggtgcaggtccgtcacactcacgtccccatgggccggccggggagggaagccacagctcaggaggtaggctgcaccagacagacagcgggtagcagggctcactttcccatgccaccctctcatactgatcccccagcacttcccccctctcctttcaggccaaccttccaggggcacacactggctccatactggcgtacataccgagaaataagagctcctcacacaggcaccttgcctcgcgaacaggaaactccaacaccccttatctcccccactcattgtaattcaccctcgttggcccccattttatagatgaggtatctgaggttcaaacaagttattctggaccccgctactcatttgttgtgtgacttcaggcaaatcaatgaactactctgaacttcatccagctgtaataacagtatttgcagagcttgttcagctcccaaagtgagtccacacagagattttgaggtcagcagacaaagattatgtgacctggctaggcatgctggctcacgcctgtaatcccagcacttttggaggccgaggcaggtggatcacgaagtcaggagttcgagaccagcctggccaacatggtaaaaccccgtctctaaaaaatacgaaaattagccaggcgtggtggtgggtgcctgtaatcccagctacttggtaggctgaggcaggagaatcacttgaacccaggaggcagaggttgcagtgagccgagatcgtcccattgcactccagcctgggcgacaagagcaaaactctgtctcaaaaaaaaaaagattatgtgacctgttttgcaggtgtgaacactgaggctccaagttattaaatgtctcttttgatttttcttccctccacacacacagcctttcttccaccaaggtgccctgtggtataccctcagctcctcagcttccatccagaagaaccacttgaaacttctttttttttttttttttttttttttttttttgagatagggtctcactgtgttgcccaggctggagtgcagtggtgtgatcatagctcactggaaccttgaactcctggcctcaagcaatcctcctgacccagcctcccaagtagctgggactacaggtttgtgccaccatgccccgctaatttttaaattttttgtagagatgacatctcagtatgttgcccaggctggtcttgaactcctggcctcaagcaaacatgaaacttgttgaggaaatttgactattttgtctttttgtttttgtttttgtttttgaggagaagtctcactctgttgcccaggctggagtgcattggcgcaatctcggctcactgcaacctccgtctcccgggttcaagcggttctcctgcctcagcctcccaagtagctgggattacaggtgtgtgcgaccatgcctagctaatttttgtatttttagtagagatgggattttaccatgttggccagggtggtctcgaactcctgatctcttcagacctcctgacttcactttcactgggggattcatttacaggccactgagtattaagatctttaaagacaaaatagtctttaaaggcacagtggctcacgcctgtaatcctggcactttgggaggctgaggcgggcggatcacctgaggtcaggaaaaagacccaggccttgtcctcaggagtccattgtctactgagatgaacataagaacaaccttctagaacaaagtggtttcaataaatggtagctttgggaatggctgcccatgcccaacagaatcaagtctgaatgctttagtttgacattcaagccccttccatagttaaatgcagcccagcacattccaggttcagggttgatctcccaagaccgatatagcctacacaacacagttttgtgactccttaattttccacctccatattttcgcttgtgctctccccctactttctcatcttttaagagatcagactggggggcttatgtaccacctcttccaggaagccttcctgactctacatctctccaacagttacttgttctcttacctgtacacagtcctgcatgcatgattttgtcatcacattaaccattgtctttttttttttttttttttttttttgagagggtctcactctgtcacccagtctggagtgcagtggcttgatctcagctcattgcaacttttacctcccgggttcaagtaattctcctccctcagcctcccaagtagctgggattataggcgtgtgccacgactcctggctaattttggtatttttattattatttattttattattattattttttgagacggagtattgctctgtcacccaggctggagtgcagtgacacgatcttggctcactgcaacctccgtctcccaggttcaagcaattctccggcctcagcctcctgagtagctgggattacaggcatgtgccaccatgcccagctaatttctgtatttttagtagagacggtgtttcaccatgttggtcaggctggtctcgaactcctgacctcgtgatctgcccgcctcggcctcccaaagtgctgtgattacaggcgtgaaccactgtgctggtattttcagtacagacagtgtttcactatgttggccaggctggtcttgaactcctgacctcaggtgatccacctaccttggcctcccaaagtgctgggattacaggcgtgagccaccatacctggcctaaccactgtctacactggcccaagccttatttattttgtgtcctaaaaggctagtctatgaggtcaggagttccagaccagcctggccaatatggtgaaaccctgtctctaataaaaatacaaaaaattagctgggcatggtggcacacgcctataatcccagctactcaggaggctgagacaggagaatcgcttgaaccaagggggcggaggttgcagggagctgagattgtgccattgcactccagcctgggcagcagagtgagactccgtctcaaaaaaaaaaaagggctagcctggctgatcaatgggtgcagccaagaggcagcatggatcggtgcaaagaccactggatttgtcatcaggcagacctgagttccagttctagctccagaacttactaactacatgcctttgagcaggtgacttcatctctaggggcctctcacctattaacggcaataataattcctatcagggaagattggcctgaaaattaaataaaagaaacacgcaaagcacctggcacatagaagctgctgagaaaacgttaatcacccacccctcagcctcaattaatgaatgactgggagccagggactcggggatctgttgtctggctgcaataaacgtgcagatggttgagcaatctacataacctttgagtcttttccttcctttgagagatagaactgacaatggccactctcagggtttctgtgagaagcaaatgaaactaaggttggtgaaagggctttgtaatgggaaagtttgctgaacttggggtgaggggtgaaggagactttggcttttcagagaaactaatgaggccactctggaccagaggccccagctagtgcaggttgggaagggctgaaacagggccttggtcccaaaggtacccagtgcagctgcgaagcagggaagactgagcaatgaaggccaatttgtgcaatagtcctgcttccccaaatgttccacttagcctaaggagtcctattttcagtgccctggggaagtggctgcttaaaggagccagtggggagccatatcttcagatttcacaatatctgaaatccagcacttggcccaggccctccaggaatgctcttgctccccaataaccaggtccctactgccaaatacacgtcccccagcttgctggcccccgatgaataggcacctttgctatgcacacatgagcccctaaggcaggtcctgagcagaggcctcaaaagaggctggagaggacatgagaataggattcagggtgtaccctgcatgaggcacacaaggcatctgcggtcagcagagctttcaaggagggcagagtgcgtgacaccagccaaggccatgcggtgatgtgaagggggcattggcccgacacacagttctctctgtctccatgaagcataggaagacagtggggtctggaacagggcactggctgggcccctttcctcatgcacacatgtctgctagaacacacccttgtactgtgggaaggttcccgcacacacaggtaagcatggatgtacacacatgtgcaggtcatctgtcataggtcctaacaaatgcagtcgtgcgtgaatacagcccccctttcctgcccccagaagtcagaaggatctttaaattgcaaatctgaggctttcactttcctgcttaaaacatttcaggccaggcaccatggctcacgcctgtaatctcagcactttgggaggtcaaggcaggaggatttcctgaggtcgggagttcgagaccagcctgaccaacatggagaaaccccgtctctactaaaaatacaaagttagccgggagtggtggggcatgcttgtaatcccagctactcaggaggctgaggcaggagaatcgcttgaacccgggaggcagaggctgcggtgagccaagattgcgccattgcattccagcctggccaacaagagcaaaactccatctcaaataaataaataaataaataaataaaattcaaattaggaggcctggcgtggtggctcatgcctgtaatcccagcactttgggaggccaaggcgggtggatcacttgaggtcaggagttcgagaccagcctggccaacatggtgaaaccccatctctactaaaaatacaaaaattagccaggcgtagtggcaggtgcctgtaatcccagatactggggaggctgagacaggagaatcatctgaagctaggaggcagaggttgcagtgagctgaggtcatcaccactgcactccagcctgggcaacaaagtgagactctgtctcaaaaaaaaaaaaaaaaaaattcaaatatctgcctgtcacacctgcaggttgaagtagtctggactgcttactgaagcagataaggctctttatggtctgaatctgacctgcctcccagcctggtctctggcccatttccccttcacccgcttctgtgctttgaaagtaatagcagtgactgacagttttgagctctcactgtgtaccacacgctgtttgtgtttttgtttgtttgtttttgagacagagtttcacttttgtcacctagcctggagtacaatggcgcaatctcagctcaatgcaacctccgcctcctgggttcaaacaattctcttgcctcagcctcccaagtaactgggattacaggtgcttgccaccatgcctggctaatttttgtaattttagtagagatggggtttcaccatgttggccaggcaggtcttgaactcctgacctcaggtgatccaccagccttggcctcccaaagtgctgagattataggcgtgagccaccacgccaggccacacactgttttaaacacttgacatgtattaattcatttgatcttccccataatactaagtattgtgatccctatttttcagatgagatcatgaggcacagaaaagttaagtaacttgtcccaggtcacacagctaggacaattctatcttccatgctgaattccttcacctcatctgggggtcatgtcttctctctctgggtcttggagtgtgctttttcatccacttagccatctgcctccctccttctctccctccctcccaccctttccctggcgaatttatccttcaggtctcagcttagtcatcatctcctccaagaagatgtccccatattccttgggagaaatttaggtcccttggctatgtgctgcccccgctggtgtttctgccatcatattccttatctccttgaattataaccatcctgattactcatctgtcttcctacctagattctgagctcgttgaagccagatttacacctggtttgttcattcctccttcaaggctaacacagggcctggtatgaagcaagcacttgataaacatttgttggattcaatggatgaattgtccctcggatgtgtgcacagatctgtgagtgtgtgagataagtatgcatgggtctcctctgagggccctgccccccagggtcgcagtcaggaggaaaagcccccttcggcaccctgtgcttcgatggttcttaaagatgtcccctctataggccgggcacagtggctcttgcctgtaatcccagcactttgggaggctgaggcaggtggatcacaaagtcaggagatcgagaccatcctggctaacgcggtgaaatcccatctctactaaaaatacaaaaaattagctgggcatggtggcgggcgtctgtagtcccagctacttgagaggctgaggcaggagaatggcgtgaacctgggaggcagagcttgcagtgagctgagatcacgccactgacctccagtctgggcgacagagcaagactctgtctcaaaaaaaaaaaaaaaaaaaaagatgtccagtgtatgcagtatggcccctgcccttccagcagcaccctcaaactcctcaccctgatagtggatcctgaagccaccgccccttgggacccgtgggctctggaagtgcagaagcagccggttggttgggctccgaaggacttgtccttctccaagcatggatgagttggccaggagtcggggggccaggcctggggatcccccaccagccagcaccaggagctcctcttcctgtgacaggttcagcgtctgcacctagagaagccagacacagacccgccagggcaagtcagccaggtgtttgacttccaaagcccctgtcctgtgcctttgccctgtgtgtagcagcccaaaaggcaccacgctgctgcccaagttgtagaaatctagaagagtttttgaggtcacctgagtcatcagacaggttctttggctcccaggccaaacccgtgcacacccacagcccagaggaaaaggcttggaagctgcacagtcacatgctttggtccagttacctggatctcaatgccgtagccagggtagacatggatgctgtaagtgcagtccaggagccccagggtgcggctgacggggctccccagatctggagactccacatacccttcgccctcggagatgttgttattacacagaactgaggagatacaaatggctgggatggaaggaatgcctgtgcttttgccctcccagccaagcaactctggccttcatctcccttctccttagcacttctcatcatctttttgttttgtttgagacagggtctcgctctgtcacccaggctggagtgcagtggtgcaatcatggctcactgcagtctcaaattcctgggctcaagtgatcctccctcctcagcctcccgagtagctgggcccacaggtgcacatcaccatggtgagacaatttttaaaactttttgtagaaatggggtcttgccacatttcccaggctggactcaaactcctggcctcaagcgatcctcctgccttggcctcccaaatcactgggattacagctgtgcgctgctgtgcccccctcaccatcttttatttttttatttttatttttttaagatggagttttgctcttgttgcctaggctagagtgcaatggctggatctcagctcaccacaacctccacctcccgggttcaagcaattctcctgcctcagccttctgagtagctgggattacaggcatgcgccaccacgcctggctaattttgtatttttagtagagacagggtttctccatgttgctcaggctggtctcgaactcccgacctcaggtgatctgcccgcctggcctcccaaagtgctgggattacaggctagagccaccatgtccatcactatctttaagcaatgctccctctcccacctgagccagaactccctttcccaactgttatatagctgaaacaattggaacactgcctggtacatagtaagggtacagaaatgctacctttgttattattattctcccatctgtacccaggactccttccacagttcccagcagcctctctcccatccatccccagcgtgtacctctccggtcctcccacccccatccccttgctgtcgcctcacctgggctggtcaccgtagtggtaacagttgtcgtggtgatgatggtggtcgtcgtctcctcctctcctccctcaggcccaaggggaggccctggggaggcagggctgggtgggggtggggctgtggttcctgggggcggggtcagcagttctggcgcagtggggcctgcccccctgaccccgttaggggtgacggctgttgtcagaggccctgtccccggctcagtggcccgtggcagggagggcactgcgagagtctggccggccggaggggtggctagcgtggggtcccgatcagatcctgggacagtgcagggaatatcagagcacaggaggagcacatggaggaccttgggtggggagcagggctgagggaagctaggggttcccctgccataccacaaaagcctcccgcacaaggtacagcaccccccacctttcccttccccaccccagcccctacctcctcccaaggcttccacagcctgagtcccccctctttctcttctggtcccttctctccacccagccccttccaccctgatactcctctccctgagcctctctctctgcctcctcactcagatcacgttctctctctggttatctcctctctcctctgtctcattctctctcgaactctttatttccccatttccctgtttagtattctgattgcactctgatttcatgattcgagatccactagtttttgtgtttcattctctctgtctctgtcttccaccatttctctgagtctggttctctgaatttccatctctgtttctatgtgtctgtttttctgtctgactgtcacctaatcattctgtctctgtctctctggttctgtctgtgcccaggtttgactttctctgacagtctcgttctgtgttccctgaatctcacaggaatgcaggctctttcctctgcagtctctctctgcctgctcttctctagcctggctccccatctccctgagcccatatccctccctctgcctctaggccactcctgccactctgggggcctcacctggcaggtagcccatctctgggcccctcctcagcagggccccatgaagcagttcagccagggcctcagaggccaccgtgggggtctcacttccaggctctggcaatatctcctcctccttcaggggcagacctaggaggtgaagttgtgtgagcttctccacttccccacaccccttccttctccagagagatattttctagaactcttcctccctcctccatcagctgggcctgcaggggctcagatggtcccaggctcgactgagggccaagatcggaggaggggctcccagctgccctcatactcccactcccacacctcttctctcccctcccctctcccttctccctgggctgtgtgggccttcattgaacaccttagctcttatggaccctggacagcgccagcaaggcagaggggtcgccggtgctgccttccctttcacctcagtggtgatctccccccaaccctggggctctgcagaggatctggccgcacctcccagcccttgcttccgcagtgcctggctttctctctgggtttctgtctctgcagtgtggctgtcttttctctctctctctctctctctctcccccccaccctctctctctctggtcctctgcagtctctgcctccttccctggagtctggctgggggtcagagtgggggactgaaaatctggtctttgagccctgcctctgctcatctgtctttgtccattcatccaagaacagttgtgtgtacagcgcctggcatctctctcagcacctccatctcccacccaggtccctccatgcttctgccgcctccgcagacatccccccaactttcccagccctccttcttggatctagcccctgagacactgctaaaagcttctctcattcatttctctgccttctcaatattgagggttaaggggcttcgggttcaagcctgaaagctctggcttgccccttccccatcagctgtgcctctcccctcccccatgtgctcggaagacccaggatattaagagaaaggagggtggaggaccccgctggacgccttcctggggcccacccccacagtctcatgtccttaccctggatccagggacagctcagcagaattaggaacagcagctggggaggcggcgggtgctgggccctgggagtccccatggcgactcaccccgatctctctcctctgtgcctctctaagtaatctggctgccacctttcctccgtctccgtttatctttccctttaattgttttttttttttttttttttttcctcgtaggagtcagcaaagaaagacaatttctctgccccttgggatggaggggcagaattgggctaggggtcgcctggagcccacccccctttgctcagtctcctctgtcctcttctcgcggctct

SEQ ID NO: 1303 - DNA, 28101 bp, Homo sapiens; identical to SEQ ID NO: 1302

SEQ ID NO: 1304 - DNA, 28107 bp, Homo sapiens
attacaagtggcgattttctgtttattgctcaaaaacaagaattcagaagcaaaggtggagagactgtgggttggggagatggcaggaagggggcaaggccttgtcccagctctcccctttgtccttcttctgaccctcctggccggagtcaggcctagggccagggcatctgggaggggggcaccttcgtggccaagggaacagtagagctatcgggggcagtccttgaggggtgccctgggcaggaggggctgcaagatttgcagggaggcagagttcccctcccagaatccaaaagccggtagggcggggggcaggcccctcgtttggcaactgagaagaggcggctttgggcggcaggatgctggtttatttactgtaggatctccagggccatcaaagccccctcgtgggatagggagactatttacacagccagggaggagggcagccaggaggcagagaccgggtcccgtatttccctctgcccgaatgaggaggggaggggcgtcctgggtcctgcagctgtagtcttggggttcagatggaaacttcatactcccgcgtatcctgaagacagagagatcaggtcagttgttggagtctgataggggtggaagaggcagccgaatgggaggaggggcaacgatcctgggttttaaagtaacattgacctctaggggctggggggccagtgaatgtgtttggttcatcctacggtgtcgtaaaatgacacaaaaatctgaatttctggcttgtcttgaataattggaagatctgccaattgtgcctcagtttcgactatggggtagagccgtattcttgagatggggcacaagtcctccacttagccacagtcctcaccactccctattgtatacacatggcttgctatgctcattgacatggcctctgggggcagctgagtttgaaattcccaagacagagattccagagaccttgcgagaaggttatggagtcctgggagagccaagtggtggctcttcaggggcaggcaaggtgcttaccccagcttcatacagcgggttgctgaagtccgactccacggtgatggggctgtaggagtgggagcccgagaagccgaaaagggactttccctgaagcctgggaaagggagaggacagaggagcttatcaacaggtaagcccctgagctcccctgacccaggctccagtgccaggctcgcaagacgtctgccctggccggcagtccccaagcaggctacttacttggtgtagtagatgtaaacgccactgccgaggacaatgaccaagcctagaggcagcaggatggccagggccaggttccccccttccagctgccgtgatggatctgtggtctgggtcactacaggaggaggagaggccggtgagctgtggctgggcccggtcctgggctctcccagcctcctgccctgggcctcaaaccctgggcttcatccctccaaggcctggcctcctgccccagcctctgccttgccctcccaacctggccagcctgggtctccacctgtgctctcactgaccttccagttttcggttgtccaggagctcctcataggcaactgcagggagaggagggggaggggatggggtctgagccagggaggggaggaggctgggaggggccgggagcccggtggggctgggctggacagcctggttctctctgccctctgctcaacctcaactttctccctttgtggggaagagagaggagtgaccagcacagggcctttgtcctctttctccagacccctaaaaagtcagggttcctggacagtctgagccaaactagaacttgtcagcgatagggaaactgaggcctattcagagcaagggacttccaagccaaggccccctctactacacccctgagccaatcccatgacctcacacgacccagggcttctggacacacccgtgaggacacgaggccacaggaggagaaccgggagctctgtggggtcgcccattggtctcaaatgtgctacctgactctcccagccctgtcacttcccggacactggtgtgcccctcctgccctgtctggccaggcacctttgcagagtgggggctggctggtccactgggaggggtggccgggcacacaggtgatggtgacctcgccgataagctcaaagccctcatagcagaagaagcgcagagactcgcccgcctggtagtggtgcttgtacagcgtctggtagccattctcgggaacccccgggttcaggcacggctcgtacttcactgcggggagcatgccagtcacgtgccagctgcactactgtgcacggggcagacgggctctcccagggctacccagccaccctcccagggtgtgccccagactcacaggcgcatttggggaccctatcgctccacttgggtgtgcctgtgtcccggctgtagcaggtgagcatggctgccccctcgaggctgtaccctggcaggcagcggtactggacgtgggagccaacggggaagccggcgtccgaggcggtgcggtgcccgttggcaatctcgccagggtcagcacaagtcatgactggtggcagaagaacaaggtcagggggagcgagggccttcaaagatcagcctgggcaacacagagagaccccatctctacaaaaaattgaaaaattagccaggagtggtggcgcactcctgtggttccagctactcaggagttggaggcgggatgatcgctcgaacccagcaggtcgaggctgcagtgaatggtgaccacgctactgcactccagcctgggtgacagagtgagacccagtctaaaaaaaataaaagaaaatctcccagaagcttagggctgggagaggcctgagcctcaggctgtttcctctgaacacctctgcacacacacgcacttcccaccaattcctcagaaggaagagagcatgaattggaaaaacttaaaatgcagtgcatctattttcaggccagaatgacaggcttaatttttttcaaaattcaacgtatgttatatttcaggcttcgtttagtaaacagtttgcttggggaaaccccaagcccctatcctggggtgaaattcaaaatatttaaccaccataccagagcatactagccaaatcccagcagggtgagcccaacatggcttgtagtctgtggaacagcagctgccctctttagagggggcccagctctcctgtccccagtattctcattatgcccagcccagttcactcacatacactccctgccttcaggcgtttgagtttacaaccctgttgtgaaggaatcataatcatagccatttcttgtatataagcctgagctacgtaccctgctaaatgttttacaaacaaatataattctttgtgtgtgtgcttgttttttttttttttttttttttttttttttttttttttgagatgggagtctcgctctgtcgcccaggctggagtgcagtggcgcatctcggctcactgcaacctctgccttctggactcaagagattctcctgcctcagcctcccgagtagctgcgattacaggcattcgctaccatgcccagctaatttttgtatttttagtatagacagggtttcgccatgttggccaggctggtctcgaactcctgacctcaggtgatccacccacctcagcctccaccagtgctgggattacaggtgtgagccaccacggctggccccaaatataattctttgttttggagacgagaacttgctctgtcactcaagctggaatgcagtggtgagatcacggctcactgcagcctcaaactcctgggcttaagcaattctcgcaccacagccttctgagtagctgggactacaggcatataccaccatgcctggctatattttttattatttgtagagacagggtctcactatgttgcccaggctgttctcaatctcctgggctcaagtgatcctcccaccttggccttccaaagcactgcaatttcagatgtgagccaccacacctggcacaaacataatatttaatcctgattatcctgagaggccaatgtcactgtcatctcccttggagcccagggctcagggcggtcaaaggacttggcccatggtcattcagccagggagtggcagagccggaatctgcccagggtcacagccatggagcactggacagggactcagatatgtgggtcctggcacaccttcaggctcaatctgctgccttgggcaggttccctcctgagcccgaggcagcggggccagccgaactctcagccccatccaggcctgatatcctgtgaatccttccaggggcgggaagctttgtccagcccaaatctggctacctgaagcttctccccttggtcccaccattgcttccagatgccacatggaactacagccccatgtccttggggctggcttcctaaaatttggagaaagtaaccagctgccattcctttctgctcttcaattttctttttctttctttctttctttcttttttttttttttgagatggagtatcactcccgtggcgcaggatggaatgcaatggcacaatctcagcttactgcaacctccacctcccaggttcaagcgattctccttcctcagcctcctgagtatctgggattacaggcgtatgccaccatgcccagatagttttttatttttagtagagacggggtttcaccatgttggccaggctggtctcgaactccagacctcaggtgatccaccgcacctggccctttctgctcttctaaaagatacacactcccagctcctttaaatgtcacctcctctgtgaaatctcctgccccagccctgagaaaattagcccactgctctccccacagcacttcgccacgcccagggcagcatgcgccctgtgaactttccatctgctcttcacaacctcagtcctacttcgccgatggggaaaccaagcctcagaaatgctaagtgcctcgcccaaagtcacccagtgatcaccaccctgcgtatccctcccagactgcgagctccataagagtatggaggggcttgaacccccttcgcctaaccccaacccagcacggggcttcaatgatggcattcaaataaaccaagtgctctgacaagccttggtcctagcaaagtggctccctacaatttcaactgataggactgcgggattggggcggggcgtaggacaggaaggtggagccaagtgtggacccggggagcccagtgggaacctggtcggagcccttttaggggccaaactcagatgccgcagaggaggggtcaggaggggacggggcggggccgtgagacgaggaaacagggaccgagcccaggtcggtgcaagaaagagggatgcagcccggagaagatgagagggagacccagaggggacagtttcggggaaccgggcggaggagtgagaactaaagggcatgggggcaggccttgaagaagatccaggaaggaccccgagcgaagggatggaacccagaaagcacgggggtcgggacaggacaggccgacgacggggcccacagggaaggggcggggccgaggggacgcgggcggggccggctcactcttttggcaggcgggcggcgcggcgctccaagacaggtcccactggcaagtgagaatgtcggagcctagcagctcgtagccaggctcgcactggtaggtgagcaccgtgccccggatcaggtccccgtgggatgccgttctccagccccactccggaggtggcagctcggggcacgtgtcgttcctcgggacctctgcaggggagggaaggcgagtttggaggctgcgttttaactgcgggctcccttccagcctcggaggctttgctctgtgccccctcccgggatctgtctctctctctctctcttagagacagggtttcctgtcgcccaggctggagtacagtggtacaagcatagctcactgcagcctcaacctcctggcttcaaacgatcctcccgcctcggcctcccaaggccccgggataacaggcgtgagccaccacgaccggccacctcccgggatctctggcctgcccgacccctgcccatcccgggactctatccctcagtacctttgaagtgcaatacgaagccctggcccaggcctggatttgggggcccgggcggtgcctgaaactgcagtgtgaggtcgggcccagaggagagaaggcggcggcgcggctgaggtccccgcagctgggccaagactcgggcgctgggaccgtccccgtcgaacagcgtcagcatgtccccttcccgcacattcaatctgcagggggtgagaccaggcaatggggcggggctgcgactggcccctcccatccagctctgccccatcctcaactctgctcattggtagcccctcctactctccagccccgcccatattctcctatcccaggtctggcgccgcctccgttttgaccaaccatggtttctcctatgctagtgcctcagggttcccctattctatggctcctcccatgtcctactacccaatccctaagcttgcacattactaactccgcccactgtccactccctcctccatcaccatgagatccacagcctagcccaactccagctctggccaatcacagaccaaattcgctaacgccctacacaactctaggccccgcctgagtacctgctttgaagccacgcccacttcagcttctgtgccatctcatgacactctcataccaattcagctcactggattctccccagacctccccaacttgctggtgttaacgcaacagtttgggtctgtgtccgtggaaatagctccaggggaagcctcagaaacctccaaagagtgagaggcaccaggccagagccccttgttcacagtggcccctaaggaaggctgcattgccctatttatttgtccgaggttgcctggctaatatgtgatttgagcccagctctctcacgtctatcctgtacccttagtgcaccagcctatccaccgaattctggatagatacgcaagagccagacaggctcagaatgcaggctactgcattggcataccacactttgctgagcctacacccgtcgcaccctctgcaggacccaaacatacatctcaacttggagcaagatgcgcttctcttcctggacgtgcacgccccacacgcagtcttggcccgggctatagctctggggccagtcgggagagaggaccacgccagctggttccgacagctcccctccacacatggctagggaaaaaggggtgtcaggttcaggacccaggtgggcatgctgtcttcatttctccacagtcctcaccactcgtgatgcgtgcaccacatcacctcgcttgtttcctattacctatgatccacctgtttcttttattcttttattttatttatttatttatttttaaattttttttgagacggagtctctctgtcgcccaggctggagtgcagtggtgcgatcttggttcactgcaagctctgcctccctggttcacgccattctcctgcctcagcctcccgagtagctgggactacaggcgccgccaccacaccctatttttttttcttttttctttttttttttttttgtatttttagtagagacggggttttacggtgttagccagaatggtctcgatctcctgacctcgtgatctgcccgccttggcctcccaaagtgctgggattacaggcgtgagccaccaggtccagcccctatttttatttttttagacagagtctcactctgtcgcccaggctggagtgcagtggcgcaatcccggctcactgcaatctccacctcgcagactcaagcgattctcgtgcctcagcctcccaagtagctgggattacaggcacgcactaccatgcccggctaatttttgtatttttagtagagacggggtttcactctattgaccaggctggtctccaactcctgacctcaggtgatccgcctgcctgagcctcccagagtgttgggattacaggcgtgagacactgctcccggctttatccacctgtttcttttttctttctttctttcttttttgagacggagtttcacacttcttgcccaggctggagtgcagtgctgcgatctcggctcaccgcaacctccgcctcccgggttcaagcgattctcctgcctcagcctcctgagtagctgggattacaggcatgcatcaccatgcccagctaattttgtattttaagtagagacagggtttctccatgttgatcaggctggtctcgaactcccgacctcaggtgatccgcccgcctcagcctcccatagtgctggtattacaggcgtgagccaccgtgcccagccatgatctacctgtttcttgccgcatctaggtcctgttgtgttcaatatccagtcctgctcttaacaaaccctgcccactctccagcctgcccaatctgtgacttaacccaacagcagttctcgctcttgaagacatttgggtttgtgacccctgcattcagtaacaagcccagcagttattcagctaagaaaacagcctctgaagggacagggatttacccaaggcttgggtggatgaagtctggatgtgcagccttcctttctgaacggccttgctgggatccccagttcagggggcaacgtggactgaaggacatgcctgcgacaaggaaggctcacctttgcaggccggctctgtgtcgttccagtggggttctgtgggatccacacattcgatggcattggggggcccagggggctccagggcatatcctgggaggcacgagaaggttgccagtgcccctgggcgatactcagggtccgtggtagtgacatttccatgtgccaggaagggggcgaagcagcgatcctcctcaaaggctgggaaggagtcagtcataacaattaagcattaggacaggcctcaagggatcttaaattggggatgtgggctgaattggggtgttctttggccactcactgggcttttttttttttttaaacagtcttgtgctgtcgcccaggctggagtgcagtggtacaaccttggctcactgcagcctctgacttccaggttcaagcaattctcatgcctcagcctcccaggtagctgggattgcaggcgtgcaccaccatgcccagctattttttttttttttgagatggaatttcacacttgttgcccaggctggagtgcaatggcacaatcttggctcaccgcaacctccgcctcctgggttcaagcgattctcctgcctcctgagtagctgggattataggcatgtgctactacgcctggctaattttttgtatttttagtagagacggggtttctccaggttgatcaggctggtctcaaactcccgacctcaggtgatctgcctgcctcggcctcccaaagtgctgggattacaggcatgagccaccgtgcctggccaatttttgtattcttagtagagacaggggtttcaccatgtcggctaggctggtcttgaactcctggcctcgagtgatctgcctgcctcagcctcccaaaatgctgggattacagacatgagtcactgcgcccagcctgggtttttttttaatttttttagagacagggtctcactctgttgcccaggctggagtgcagtggtgtgatcacagctcattgcagcctagatcttctaggctcaagtgatcctcccacctcagcctctctggtagctgggactacaagcatgcacaccccacccagcagctcattttctgattttttttttttttctgtagagatggagtttcaccatgttacttaggctggtctcgaactcctgacctcaggtgatccgctggcctcggcctcccaaagtgctgggattacaggtatgagccattgccctggcgttggtgggtttttaaaaactgaatgccactgggtttagcattcactctccagactgtcaaaaaaagttctaacactcctcattcacatatttatattgcctccctggcctctggagggaagccactgagctagccaaatcccagccaccattctacagagcggaggtccatagaccaaaaagccacttgctcaaggtcacacaaaagacaatggcaaaagcaggtctcaaacccagatggtttgattcccagccacagatacttggctctggaaacagcagagatagcgggtaaggggaggggtgccttcagagaactggctggtgtaggtgtattgtctcctcagaaataacagttggattctgatcatccatgctgttgctgaaacccaaaatttcagctaatgcaaaaactactcagtttttacttcaagtcagcaaaagtgaacatttgtagagcatttgagtttctgcccacctgatcggatcttagctgcaaaactccctgtaagttaagatttaggtgcctatgataccaatgaggaattcttttttttttttttttttttttttgggatggagtttcgctcttgttgcccaggctggagtgcaatggtgtgatctcggctcactgcaacctctgcctcccaggttcaagtgattctcctgcctcagcctcccgagtagctgggattacaggcacccacaaccacccccggctaatttttgtatttttttagtagagatggggttttaccatgttggccaggctggtctcgaacacctgacctcaggtgatccacccgcctcagcctcccaaagtgctgggattataggcgtgagccaccatacccggccttttttttttttttttgagatttttaattttattttaatattttatttttttattttttgagactgagtctcgctctgtcgcccaggctggagtgcagtggcatgatctcacttcactgcaaactcggcttcccaggttcaagccattctcatgtctcagcctcctgagtagctgggattacaggcacgtactaccacacctggctaatttctgtgtttttagtagaaatggggctttgccatgttgcctaggctggtttcaaactcctgggctcaagtgatccacctgcctcagcctcccaaaatgcggagattacaggcatgagccactgtgcccgggttattttatttatttttaaaaatgaggccagatgcagtggctcacacctgtaatccccccactttgggaggctgaggcaggtgaatcacctgaggtcaggagtttgagaccagcctgaccaccatggtgaaactccgtctctactaaaaacacaaaaattagctgggcgtggtggtacatgcctgtaatcccagctactcagaaggctgaggcaggagaaccacttgaacccggaaggcggaggttgcagtgagccgagattgcgccattgcactccagcctgggtgacaagagcgaaactccatctcaaaaaaaaaaaaaaaaggaaaaaaatgagacagggccttgctctgtcacctaggctggagcgtgcaatggtgggatcacaactcacagcagccttgacctcctgagctcaagcgatcctcctgcctcagcctcccaagcagctgggaccacaagtgtgcaccaccacacctggctaattttttgttttgttttgttttgtagagacaaaggtcttgctatgttgcccaggctggtctccaactcccaggctcaagtgatcctcccatcttaacctcccaaagtgctgggattacaggcgttagccattgtgcctggccacagtgaagaatcttaaactcatagaatagcagtggcctacaactctggagtcaggactcacaacttgctattttcggtaaaagatctgtgctgtttgcactttaacactcccagaatctatcccgcaattcatttttgcagatccactgttctatttcactgttacttaacctgcaaggtatcatgtccaaatcctacccatccatcacagccgagtgccaattccatttctcccatgattcatatcaaacactagaccctcctatctctaagcatttcatctttttggtctctctcttgctactgtttatacaactcctctgtttcagccacaatgaaattctgtttcccagacataccaggcatttccctacttgctgtttctcaaagttcctctctttccttttcttttcttttcttctttttttttgacagggtcttgctctgttgcccaggctggagcacagtggtgcaatcatagctcactgcaacctctggggttcaagtggggttcaagtgatcctcccacctcaaccttccatgtagctgggactagaggtgtgtgccaccacacctggataattattacttttttttaatttgtagacacaggatctcactatgttgctcagactggttctcaaactcctggcctcaaacaatcatcccaccttggcctcccaaagtactgggattagagacacgagtcaccacaactggcctcaatcttcctcttttaaaatatcctctgttggctgggcagggtggctcacgcctgtaatcctagcactttgagaggccgaggtgggaggatcacttcagctcagtagttggagaccagcctgggcaacatagtgagatgctgtctctacaaaaaatgtaaaaattacccaggcatggtgccgaacgcttgtggtcccagctactagggaggctgaggcaggaggatcacttgagcccaggaggttgaggttgcagtgaaccatgatcgggccaccgcactacggcctgggcgacaaagcaagacctatttcaataataataataataataataaaataccctctatcctttaaggccaaggtgaaatgcctcttcctccatgatcacttccttgtttctaccccttcacattcattcctcttcttctggtaacggcatcccaattttaattttgggacgcaggccttccccactcccagtccactaggttaagttggagcccaccagggaaggccacgtgaggcagattagccaatcccaatactcccttctcctagctcagtgattggctcaggctaaggccaaccaggatcttagtcaggtcaatgaacgcctctcctggcatttttgctgagctctcaggaaatatatgagtgttctctctgatgaggttactcggttggtggtatgggctggaggaggtggcttacacctgtaatcctggcactttgggagtcccacatgggcgaatcacttgagcccaggagttcaagaccagcctgggcaacatggtgaaaccccgtctctactaaaaacccaaaaattagctgggcgtggtgatgcatgcctgtaatcccagctactcgggaggctaaggaatgagaatcgcttgaacctggaggaggggggctgcagtgagctgagatcgcgccactgcactccagcctgggcgacagagaggaactctgtctcaaaataaataaataaataaaaataaataaaaactaaaaactgtcaggcgcagtggctcacgcctgtaatcccaacactttgggaggcggaggcgggcagatcacctgagttcgggagttccagaccagcctgaccaacgtggagaaaccccatttttactaaaaatacaaaattagctgggcatggtggcgcatgcctgtaatcccagctactcgggaggctgaggcaggaaaatcgcttgaacccgggaggcagaggttgcggtgagccgagatcatgacattgcaccccagcctgggcaacaagagcaaaactccgtctcaaaataaataaaggccgggcgcggtggctcactcctgtaatcccagcactttgggcggccgaggcaggcggatcacaaggtcaggagatcgagtccatcttggctaacacggtgaaaccccgtctctactaaaaatacaaaaaaattagtcgggcgcggtggcgggtgcctgtagccccagctactcgggaggctgaggcaggagaatggcgtgaacccggaaggcggagcttgcagtgagccaagatggcgccactgcattccagcctgggtgacagagcgagactcgtctcaaaaaataaataaataaataaataaaataaaaattaagttggtggtatgtaagtcggcagctatgtccatcacacagggaaagtgcctaaggatgaagccagcacagaggaaagaaccgagatactgagataactggtctctgggctatgtacctggatccagacattcatgaagcttaaacagagaaggctgcctgggggaaggagaaggggtccctagaagagatccttgcagttttggggcagggaagcgagtcacgtttcaaggaacccagcacggagatgaacaggcatagagtttgtgcttccgactatgcttggtgtcaggaagaggggaaggtgtggcggttggggtcctgtgggggagtgggtcacttaccttcaaatcgaaggcttaacagcaggggattggcaggtgtctctgacagcagctccacgtagagggactgggcgtcactgatgagaccccgctcggggacatcgtccatgtccgaatcatagatcacgggggatagggggctgccccctgagcgcaccatcagcctgggatggacagaaacgtgaccaggagctcaatctccctcacaagctgcctcaccccttgcctgctttcctaacttatttttatagctgttatcatcacacataactatatgccacgcactcttctaagcccttacacattctatctcatttaattttcacaagaactcttgagtcagacactattattatcctttattttatagatgaggatattagggcatagaaagatcaagtaacctgtccaaggtcacagagcaagtagtggcagggctgagataccaagttgctaggtaaaggatgataatgatgatgaagatagcagatgcttgaccaggcatggtggctcagctcacacctgtcatcccagcactttgggaagccaagacgggtggatcacctgaagtcaaggagttcaagaccaggctggccaacatggtaaaaccccatgtttactaaaaatacaaaaattagccaggcatggtggtgcatgcctataatcccagctactcaggaggctgaggcaggagaattgcttgcatctgggaggtggaggttgcagtgagctgaatccgtgccactgcactccagcctgggtgacagagcgaaagtctgtctccaaaaataaataaatagataaataaggccaggtgcagtggttcatgcctgtaatcctagcactttgggaggctgaggtgggtggatcacgaggtcaggagatcgagaccatcctggctaacacggtgaaaccccaactctactaaaaaaaaaagtacaaaaaattagccggacgtggtggcacacgcttgtagtcccagctactcgggaggctaaggcaggagaatagcttgagcctgggagacagaggttgtagtgagccgagatcgcaccactgcactccagcctgggcgacagggtgagactccatcttaaaaaaaaaaaaaaaagaggatagcagacacttttatagtgcttattgtcccaggtgccattctaaggactttatataatttcagcacttatcctcacagaaacctgaagagggaagtattgttatctccattctacagatgaggaaactgaggcacaaagaagttaagtgatttgtctaaggtttcacagctacacttcctaagaaagtcttaggactggctgggtgtggtggctcacgcctataattccagcactttgggaggccaaggtgggcagatcacctgaggttgggagtttgagaccagcctgaccaacatggagaaactccatctctactaaaaatgcaaaattagctgggcatggtggtgcatgcctgtaatcccaactaatcaggaggctgaggcaggagaatcacttgaacccgggaggcagaggttgcggtaagccaagactgcggcactgcactccagcctgggcaacaagagtgaaactctgtctcaaaaaaagaaaaaaaaaaaaaaaaaggcttaggactaagctgtgatgcatatctcaaccaggatccaccccagctgtgtccaagtccccacttagcctccctacttccctgaggtggggacttctttttttttttttgagacggagtctcattctgtctcccaggatggagtgcagtggtgcgatcttggctcactgcaagctctgcctcccgggttcacgccattctcctgcctcagcctcccgagtagctgggactacaggtgcccaccaccatgcccggctaattttttttttttttttttgtatttttagtagagatggggtttcaccgtgttagccaggatggactcgatctcctgaccttgtgatccgcctgcttcggcctcccaaagtactgggattacaggcatgagccaccatgcccggccaaggtggggacttctgacccaagacccagacccttaccggtcattgtcctcatccagcgagaccctttcaaagtgcaggtgcagccggcgcccctcagctgcttcaatgacccaacggcaggtgaggttgggccctacggctcccccaggctctggggacacgatgcggcccagggtggcattgtggatggtgccaccacaggatgctgtgggcagaggaggggtacgttaaggccagcctgaggtgaactgtccttctcctcggggcctcggcccgttttcagaactgttgcattcacacatttggctgggacccggcccagggctggcctctgtcccatggagtcactccagaggatgggaccttctccaggcatgagccaggaaagaaaccagccccggtacgggagaaccccaggattgacacctcctaggatggagacaccactaaaatgaagactctccaactgcggatactctaggatggggagttacaaggatccctaaaattcaaagcctcagctgggaaatcttcaggacaggactttcagagtgaagacaccacgggatgggaatcccagtaagaggctctctaggatagaagccctctggacatgaaccctaaaaatggcttcctctaggatgaggacgctaccccagaagggacctccagaatggtgactcccaaaataaaatctccagtgggacaccccgagatggagaccacccaaggatggagaaaccccaaggagagagaccctccgcacaaagagctctggctgcagaccccaggatggggactcctcagggtaaacaccccttcagaatgggttttccccaaaggtggacacctggacacccccgagataggaccctcccaatggggttcccagaacagatgccccacccactgtggcaggagactcacccatgcagctgggggtttcaccgttccaggatggccgggtgccattgaggcagatgagggtctcctctccctgcagctggtagcccgaatcacagtgaaaggtggcagtgcccccagggtgcaggtccgtcacactcacgtccccatgggccggccggggagggaagccacagctcaggaggtaggctgcaccagacagacagcgggtagcagggctcactttcccatgccaccctctcatactgatcccccagcacttcccccctctcctttcaggccaaccttccaggggcacacactggctccatactggcgtacataccgagaaataagagctcctcacacaggcaccttgcctcgcgaacaggaaactccaacaccccttatctcccccactcattgtaattcaccctcgttggcccccattttatagatgaggtatctgaggttcaaacaagttattctggaccccgctactcatttgttgtgtgacttcaggcaaatcaatgaactactctgaacttcatccagctgtaataacagtatttgcagagcttgttcagctcccaaagtgagtccacacagagattttgaggtcagcagacaaagattatgtgacctggctaggcatgctggctcacgcctgtaatcccagcacttttggaggccgaggcaggtggatcacgaagtcaggagttcgagaccagcctggccaacatggtaaaaccccgtctctaaaaaatacgaaaattagccaggcgtggtggtgggtgcctgtaatcccagctacttggtaggctgaggcaggagaatcacttgaacccaggaggcagaggttgcagtgagccgagatcgtcccattgcactccagcctgggcgacaagagcaaaactctgtctcaaaaaaaaaaagattatgtgacctgttttgcaggtgtgaacactgaggctccaagttattaaatgtctcttttgatttttcttccctccacacacacagcctttcttccaccaaggtgccctgtggtataccctcagctcctcagcttccatccagaagaaccacttgaaacttctttttttttttttttttttttttttttttttgagatagggtctcactgtgttgcccaggctggagtgcagtggtgtgatcatagctcactggaaccttgaactcctggcctcaagcaatcctcctgacccagcctcccaagtagctgggactacaggtttgtgccaccatgccccgctaatttttaaattttttgtagagatgacatctcagtatgttgcccaggctggtcttgaactcctggcctcaagcaaacatgaaacttgttgaggaaatttgactattttgtctttttgtttttgtttttgtttttgaggagaagtctcactctgttgcccaggctggagtgcattggcgcaatctcggctcactgcaacctccgtctcccgggttcaagcggttctcctgcctcagcctcccaagtagctgggattacaggtgtgtgcgaccatgcctagctaatttttgtatttttagtagagatgggattttaccatgttggccagggtggtctcgaactcctgatctcttcagacctcctgacttcactttcactgggggattcatttacaggccactgagtattaagatctttaaagacaaaatagtctttaaaggcacagtggctcacgcctgtaatcctggcactttgggaggctgaggcgggcggatcacctgaggtcaggaaaaagacccaggccttgtcctcaggagtccattgtctactgagatgaacataagaacaaccttctagaacaaagtggtttcaataaatggtagctttgggaatggctgcccatgcccaacagaatcaagtctgaatgctttagtttgacattcaagccccttccatagttaaatgcagcccagcacattccaggttcagggttgatctcccaagaccgatatagcctacacaacacagttttgtgactccttaattttccacctccatattttcgcttgtgctctccccctactttctcatcttttaagagatcagactggggggcttatgtaccacctcttccaggaagccttcctgactctacatctctccaacagttacttgttctcttacctgtacacagtcctgcatgcatgattttgtcatcacattaaccattgtctttttttttttttttttttttttttgagagggtctcactctgtcacccagtctggagtgcagtggcttgatctcagctcattgcaacttttacctcccgggttcaagtaattctcctccctcagcctcccaagtagctgggattataggcgtgtgccacgactcctggctaattttggtatttttattattatttattttattattattattttttgagacggagtattgctctgtcacccaggctggagtgcagtgacacgatcttggctcactgcaacctccgtctcccaggttcaagcaattctccggcctcagcctcctgagtagctgggattacaggcatgtgccaccatgcccagctaatttctgtatttttagtagagacggtgtttcaccatgttggtcaggctggtctcgaactcctgacctcgtgatctgcccgcctcggcctcccaaagtgctgtgattacaggcgtgaaccactgtgctggtattttcagtacagacagtgtttcactatgttggccaggctggtcttgaactcctgacctcaggtgatccacctaccttggcctcccaaagtgctgggattacaggcgtgagccaccatacctggcctaaccactgtctacactggcccaagccttatttattttgtgtcctaaaaggctagtctatgaggtcaggagttccagaccagcctggccaatatggtgaaaccctgtctctaataaaaatacaaaaaattagctgggcatggtggcacacgcctataatcccagctactcaggaggctgagacaggagaatcgcttgaaccaagggggcggaggttgcagggagctgagattgtgccattgcactccagcctgggcagcagagtgagactccgtctcaaaaaaaaaaaagggctagcctggctgatcaatgggtgcagccaagaggcagcatggatcggtgcaaagaccactggatttgtcatcaggcagacctgagttccagttctagctccagaacttactaactacatgcctttgagcaggtgacttcatctctaggggcctctcacctattaacggcaataataattcctatcagggaagattggcctgaaaattaaataaaagaaacacgcaaagcacctggcacatagaagctgctgagaaaacgttaatcacccacccctcagcctcaattaatgaatgactgggagccagggactcggggatctgttgtctggctgcaataaacgtgcagatggttgagcaatctacataacctttgagtcttttccttcctttgagagatagaactgacaatggccactctcagggtttctgtgagaagcaaatgaaactaaggttggtgaaagggctttgtaatgggaaagtttgctgaacttggggtgaggggtgaaggagactttggcttttcagagaaactaatgaggccactctggaccagaggccccagctagtgcaggttgggaagggctgaaacagggccttggtcccaaaggtacccagtgcagctgcgaagcagggaagactgagcaatgaaggccaatttgtgcaatagtcctgcttccccaaatgttccacttagcctaaggagtcctattttcagtgccctggggaagtggctgcttaaaggagccagtggggagccatatcttcagatttcacaatatctgaaatccagcacttggcccaggccctccaggaatgctcttgctccccaataaccaggtccctactgccaaatacacgtcccccagcttgctggcccccgatgaataggcacctttgctatgcacacatgagcccctaaggcaggtcctgagcagaggcctcaaaagaggctggagaggacatgagaataggattcagggtgtaccctgcatgaggcacacaaggcatctgcggtcagcagagctttcaaggagggcagagtgcgtgacaccagccaaggccatgcggtgatgtgaagggggcattggcccgacacacagttctctctgtctccatgaagcataggaagacagtggggtctggaacagggcactggctgggcccctttcctcatgcacacatgtctgctagaacacacccttgtactgtgggaaggttcccgcacacacaggtaagcatggatgtacacacatgtgcaggtcatctgtcataggtcctaacaaatgcagtcgtgcgtgaatacagcccccctttcctgcccccagaagtcagaaggatctttaaattgcaaatctgaggctttcactttcctgcttaaaacatttcaggccaggcaccatggctcacgcctgtaatctcagcactttgggaggtcaaggcaggaggatttcctgaggtcgggagttcgagaccagcctgaccaacatggagaaaccccgtctctactaaaaatacaaagttagccgggagtggtggggcatgcttgtaatcccagctactcaggaggctgaggcaggagaatcgcttgaacccgggaggcagaggctgcggtgagccaagattgcgccattgcattccagcctggccaacaagagcaaaactccatctcaaataaataaataaataaataaataaaattcaaattaggaggcctggcgtggtggctcatgcctgtaatcccagcactttgggaggccaaggcgggtggatcacttgaggtcaggagttcgagaccagcctggccaacatggtgaaaccccatctctactaaaaatacaaaaattagccaggcgtagtggcaggtgcctgtaatcccagatactggggaggctgagacaggagaatcatctgaagctaggaggcagaggttgcagtgagctgaggtcatcaccactgcactccagcctgggcaacaaagtgagactctgtctcaaaaaaaaaaaaaaaaaaattcaaatatctgcctgtcacacctgcaggttgaagtagtctggactgcttactgaagcagataaggctctttatggtctgaatctgacctgcctcccagcctggtctctggcccatttccccttcacccgcttctgtgctttgaaagtaatagcagtgactgacagttttgagctctcactgtgtaccacacgctgtttgtgtttttgtttgtttgtttttgagacagagtttcacttttgtcacctagcctggagtacaatggcgcaatctcagctcaatgcaacctccgcctcctgggttcaaacaattctcttgcctcagcctcccaagtaactgggattacaggtgcttgccaccatgcctggctaatttttgtaattttagtagagatggggtttcaccatgttggccaggcaggtcttgaactcctgacctcaggtgatccaccagccttggcctcccaaagtgctgagattataggcgtgagccaccacgccaggccacacactgttttaaacacttgacatgtattaattcatttgatcttccccataatactaagtattgtgatccctatttttcagatgagatcatgaggcacagaaaagttaagtaacttgtcccaggtcacacagctaggacaattctatcttccatgctgaattccttcacctcatctgggggtcatgtcttctctctctgggtcttggagtgtgctttttcatccacttagccatctgcctccctccttctctccctccctcccaccctttccctggcgaatttatccttcaggtctcagcttagtcatcatctcctccaagaagatgtccccatattccttgggagaaatttaggtcccttggctatgtgctgcccccgctggtgtttctgccatcatattccttatctccttgaattataaccatcctgattactcatctgtcttcctacctagattctgagctcgttgaagccagatttacacctggtttgttcattcctccttcaaggctaacacagggcctggtatgaagcaagcacttgataaacatttgttggattcaatggatgaattgtccctcggatgtgtgcacagatctgtgagtgtgtgagataagtatgcatgggtctcctctgagggccctgccccccagggtcgcagtcaggaggaaaagcccccttcggcaccctgtgcttcgatggttcttaaagatgtcccctctataggccgggcacagtggctcttgcctgtaatcccagcactttgggaggctgaggcaggtggatcacaaagtcaggagatcgagaccatcctggctaacgcggtgaaatcccatctctactaaaaatacaaaaaattagctgggcatggtggcgggcgtctgtagtcccagctacttgagaggctgaggcaggagaatggcgtgaacctgggaggcagagcttgcagtgagctgagatcacgccactgacctccagtctgggcgacagagcaagactctgtctcaaaaaaaaaaaaaaaaaaaaagatgtccagtgtatgcagtatggcccctgcccttccagcagcaccctcaaactcctcaccctgatagtggatcctgaagccaccgccccttgggacccgtgggctctggaagtgcagaagcagccggttggttgggctccgaaggacttgtccttctccaagcatggatgagttggccaggagtcggggggccaggcctggggatcccccaccagccagcaccaggagctcctcttcctgtgacaggttcagcgtctgcacctagagaagccagacacagacccgccagggcaagtcagccaggtgtttgacttccaaagcccctgtcctgtgcctttgccctgtgtgtagcagcccaaaaggcaccacgctgctgcccaagttgtagaaatctagaagagtttttgaggtcacctgagtcatcagacaggttctttggctcccaggccaaacccgtgcacacccacagcccagaggaaaaggcttggaagctgcacagtcacatgctttggtccagttacctggatctcaatgccgtagccagggtagacatggatgctgtaagtgcagtccaggagccccagggtgcggctgacggggctccccagatctggagactccacatacccttcgccctcggagatgttgttattacacagaactgaggagatacaaatggctgggatggaaggaatgcctgtgcttttgccctcccagccaagcaactctggccttcatctcccttctccttagcacttctcatcatctttttgttttgtttgagacagggtctcgctctgtcacccaggctggagtgcagtggtgcaatcatggctcactgcagtctcaaattcctgggctcaagtgatcctccctcctcagcctcccgagtagctgggcccacaggtgcacatcaccatggtgagacaatttttaaaactttttgtagaaatggggtcttgccacatttcccaggctggactcaaactcctggcctcaagcgatcctcctgccttggcctcccaaatcactgggattacagctgtgcgctgctgtgcccccctcaccatcttttatttttttatttttatttttttaagatggagttttgctcttgttgcctaggctagagtgcaatggctggatctcagctcaccacaacctccacctcccgggttcaagcaattctcctgcctcagccttctgagtagctgggattacaggcatgcgccaccacgcctggctaattttgtatttttagtagagacagggtttctccatgttgctcaggctggtctcgaactcccgacctcaggtgatctgcccgcctggcctcccaaagtgctgggattacaggctagagccaccatgtccatcactatctttaagcaatgctccctctcccacctgagccagaactccctttcccaactgttatatagctgaaacaattggaacactgcctggtacatagtaagggtacagaaatgctacctttgttattattattctcccatctgtacccaggactccttccacagttcccagcagcctctctcccatccatccccagcgtgtacctctccggtcctcccacccccatccccttgctgtcgcctcacctgggctggtcaccgtagtggtaacagttgtcgtggtgatgatggtggtcgtcgtctcctcctctcctccctcaggcccaaggggaggccctggggaggcagggctgggtgggggtggggctgtggttcctgggggcggggtcagcagttctggcgcagtggggcctgcccccctgaccccgttaggggtgacggctgttgtcagaggccctgtccccggctcagtggcccgtggcagggagggcactgcgagagtctggccggccggaggggtggctagcgtggggtcccgatcagatcctgggacagtgcagggaatatcagagcacaggaggagcacatggaggaccttgggtggggagcagggctgagggaagctaggggttcccctgccataccacaaaagcctcccgcacaaggtacagcaccccccacctttcccttccccaccccagcccctacctcctcccaaggcttccacagcctgagtcccccctctttctcttctggtcccttctctccacccagccccttccaccctgatactcctctccctgagcctctctctctgcctcctcactcagatcacgttctctctctggttatctcctctctcctctgtctcattctctctcgaactctttatttccccatttccctgtttagtattctgattgcactctgatttcatgattcgagatccactagtttttgtgtttcattctctctgtctctgtcttccaccatttctctgagtctggttctctgaatttccatctctgtttctatgtgtctgtttttctgtctgactgtcacctaatcattctgtctctgtctctctggttctgtctgtgcccaggtttgactttctctgacagtctcgttctgtgttccctgaatctcacaggaatgcaggctctttcctctgcagtctctctctgcctgctcttctctagcctggctccccatctccctgagcccatatccctccctctgcctctaggccactcctgccactctgggggcctcacctggcaggtagcccatctctgggcccctcctcagcagggccccatgaagcagttcagccagggcctcagaggccaccgtgggggtctcacttccaggctctggcaatatctcctcctccttcaggggcagacctaggaggtgaagttgtgtgagcttctccacttccccacaccccttccttctccagagagatattttctagaactcttcctccctcctccatcagctgggcctgcaggggctcagatggtcccaggctcgactgagggccaagatcggaggaggggctcccagctgccctcatactcccactcccacacctcttctctcccctcccctctcccttctccctgggctgtgtgggccttcattgaacaccttagctcttatggaccctggacagcgccagcaaggcagaggggtcgccggtgctgccttccctttcacctcagtggtgatctccccccaaccctggggctctgcagaggatctggccgcacctcccagcccttgcttccgcagtgcctggctttctctctgggtttctgtctctgcagtgtggctgtcttttctctctctctctctctctctctcccccccaccctctctctctctggtcctctgcagtctctgcctccttccctggagtctggctgggggtcagagtgggggactgaaaatctggtctttgagccctgcctctgctcatctgtctttgtccattcatccaagaacagttgtgtgtacagcgcctggcatctctctcagcacctccatctcccacccaggtccctccatgcttctgccgcctccgcagacatccccccaactttcccagccctccttcttggatctagcccctgagacactgctaaaagcttctctcattcatttctctgccttctcaatattgagggttaaggggcttcgggttcaagcctgaaagctctggcttgccccttccccatcagctgtgcctctcccctcccccatgtgctcggaagacccaggatattaagagaaaggagggtggaggaccccgctggacgccttcctggggcccacccccacagtctcatgtccttaccctggatccagggacagctcagcagaattaggaacagcagctggggaggcggcgggtgctgggccctgggagtccccatggcgactcaccccgatctctctcctctgtgcctctctaagtaatctggctgccacctttcctccgtctccgtttatctttccctttaattgttttttttttttttttttttttcctcgtaggagtcagcaaagaaagacaatttctctgccccttgggatggaggggcagaattgggctaggggtcgcctggagcccacccccctttgctcagtctcctctgtcctcttctcgcggctctgtggt

SEQ ID NO: 1305 - DNA, 28107 bp, Homo sapiens; identical to SEQ ID NO: 1304

SEQ ID NO: 1306 - DNA, 28101 bp, Homo sapiens; identical to SEQ ID NO: 1302

SEQ ID NO: 1307 - DNA, 28101 bp, Homo sapiens; identical to SEQ ID NO: 1302

SEQ ID NO: 1308 - DNA, 14540 bp, Homo sapiens
gtctccatcttggaattgggaggaagagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggtgagacacggggtgcaggggcgcgggtccctgtgtctagttctgagaagaaagggtgcgcctttctgagaagctggacttgggtaggccctctcaggatggggaagcccagctgagcgagtggtcagcctctggctagccttgccttctgttgccacccccttccccttcctcttcccttcattgtgtctggttggtgggggacctcaggtgacagggtctctgatgtcaccggcgttcacaccctagggtgcttcagctaatcagatggatttgcacttcagtcttctctccttcactttgcccctcacagccacctctcctccctgatatgtcccgttctcctggctattctgtggttttgattcccatgcctctgattcccatggtgggtctgcttatctgcttttcaggcctggtctggttggatttcttgtccttgcaaggaagtgtgtgtatatgtgtttgtgtgtatgcgtgtgtgtgtgtgcttggaggtgcctggcaatgttttcccccagctgcagttaccttccaacctcttgctgtgatggtgtcaataatctcatccatttgtcaaacgatctgtcttttacaaagtgctttgacagccattctctcatgtgacatccccgcattcaccctgtgggggcctcttttattggcatcttcccattttacagttgagaacgttgaggccgagagaggttgcccaaggtcacacagtggcagaaccagaatttgaactcaagtcctcaatcacatctttccctgatgcatgcctggttcttgccatctcttttcctctgagtttgggctcggccaggggtccctaggagtccaggctggggtgaggtttaagaatggggatgagatgagcttcctttccaggagggctctactcagaagcttttcctgatgggagcctctggcttttgcctctgcctcatggagttttctatccactgtgaccttcatctttaccccaatcccagggtttggcctggattcctgagagggctctctcctgacaaatggtagcactagtggcatcttttaactgttcaagccaagctgttggggtagaatgatcccccaaaggattaaagctttgtggggaccttggaggcagggaaggaaaaatccatatgctgagtgtctgcatggtgttcctaagtatgagatctcattaaaatcttaacaacagctccatgctgtaatccatttcactgaagagaagaccaagaactggaaggaacttatttaaagccctgttgctgtacattgcagacgggatgtactggtagcatagcttaggaacagatagatacgggtttcctcatctgtagaatggagataacattgttcgttttggaaggtggttatgatttagcacagaccttggttattgttcaagtgtttgttgttattatggggaaggggacctgcatgatgttttgccagtgggtggcacccctccgtgtggcctaggttagcattctggggccttgtgttggtaaagaggtcaggaagattcctttggcaagttgagagcacctgcctttgtgtgtgggtgtgtggtgctggtgaggggtgcttggcactgttgctggcagaagggagaaaagggccggctttgagcaacctgcgagctgctgagggctgagcagagagcaatcactcagtctcccaggctattctgagccctctgcaccctgggggcccactggagagtcaggctccctccttgccctccagcttccagttgggctgagacaaaattaacaacacaacaggaaacaatgcatgacagaataaattacatgctaaaattgttaggtgcttttgagtagctagaactctgccccaggagtccagctctgctgaaggctcctttgtgcctaaattctgacaagtgcttaggctggagcctgtcttggaatctccttgagggttttggttctggtatcctgcaggaactttctccgggtgtttggttgggtgccctaggtgctcttcccaatggctggagtggtcaggacaggcttcctgcaagaggggagctgagcttggggtgacagctgagagagtaatggatacaggcctaaccggggagccgaaggtcctgttctctgaccttggagaagtcctttttcttctctgtgcctcagtgacctcacctaggaaatggtgatcatgattctgccctgcctgtttcgaagggctgctctgaaatcatagtgatggaggaccagctttggacaaggcacttaaccttgctgagcctgtttctttatctgtaagataggggaaatcatagtacttgcttcataaggttgtagtgaggactgaatagagataatgcacgtaaggtactcagtaaatgttatttgtaccctgcaaatgtcctgtacctgtgtgtgatgcttatgcagttggacaggacaagtaaggtggcccagagcacagagaggccctcatagccagatgccatttatatccctattcttcccattctagatctccccctgacttttttgagagtgactttgcgggctcctctgggccagtacccacttctaacaatggacggatttccaccgcctccggcctggccatttcctgttctcttccagggtgtgagaggttgagggaggagggggcctcagcgccaaggggaacagaaaggtgcctggaaacagttggggtataggacttatgggacaggacacttggggctctggagtgctggctgggaagcagaatgttttatccttgaggggagatacaggggctatagggaaatgagaacttgttgagcactgaagggggtggtgaggatacttagcttcccagaatcttcctagcagttttagggactccagggacccagcccgcgtgatctggttgccagggcaacttcattttttggagctttgatgttgttcctaatctccccctccccttcctcagcagtgcctcctcctcatcagggaatgaggggaggagatggcagaaacttgatgggtcccttcctctccctgaaggctcaatccttgatctctaagggtcccatttccattcctcaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgtgagttgggtcttgggagggtgtaatagggatggggactcttcctatccctgtggacttcccaacagcccttgcacactactccatcacactggtctttcctgccttctcttgctgggccagcaagtcttcccatgcccggctctcaatggggccttcaacaccttctggtctggtcctctaggcccgggatgtccggaatagtgaggtggtggccatcaagaagatgtcctacagtgggaagcagtccaatgaggtgggccaggtgcaatacagccaggttggggacaggggactcctgtctcaagatgcaagctgggtaacctctgcctaccctgaccccctagaaatggcaagacatcatcaaggaggtgcggttcttacagaagctccggcatcccaacaccattcagtaccggggctgttacctgagggagcacacggcttgggtgagctggtgccagattctggcctgatctttactcctattcatgcccgtccttatcgtagtccagtctcttaggtggtccctgttcgtggtgctgttgtgggatcttgggaaggaggaagtctcttttgaccgctttagtcctcagacatacccactgagcaaaagcctggctcagtgacacaggctgttagcaggtgggacaggtcactgtgggctggagaaggtggagattgaatgggagtttgaagggattcagatgggcagtggtgaatgtcttgggcccagactctagaaactctcccaccaccccctcattgtctccagttgcgcttcctccctgtcatcaccccggggacatagcttgagtacaggacagtcaaggaagctctgttttgagtccctgcccaggagactctgatctctgacccttgtctcttccttagctggtaatggagtattgcctgggctcagcttctgaccttctagaaggtaagtgactgataggccaataagtggagaagggagaagagcaggggagccatagggaagggttaaggggagtttattccagtcccacccttgcgctccctcgggttgatgttcttcctcactctccagtgcacaagaaaccccttcaggaggtagagatcgcagctgtgacccacggggcgcttcagggcctggcatatctgcactcccacaacatgatccataggtacaagcagcaccggcagtgcctgggaggggagtgctatctgcaccacctgtcacttagctgggctgcccctgcctagctttcttgagacacatgtctcatccctgtactttgcctctggcagggatgtgaaggctggaaacatcctgctgtcagagccagggttagtgaagctaggggactttggttctgcgtccatcatggcacctgccaactccttcgtgggcaccccatactggtgagtgagtgagtggtggtgagtggagagacctcccagggatgttgggagtaggagtgacagggtctcggcgggtgatttgcctctctctcctgaccattctcctaggatggcacccgaggtgatcctggccatggatgaggggcagtacgatggcaaagtggacgtctggtccttggggataacctgcatcgagctgggtaagaacatcctccctgttccctcatcatcttttccattctttcctgttagttcccagactccggactacccccttctcctagggatgggatcccaggcctccaagttcctgtccgttgtgactctaccctggagcccaatacaggcagctggcaaattctgccagctcttaggcctagagattttgtagcattcatctcttcctgtccactaccctggttctgaatcttttcttagtgcccaccatgtgctgtgccatggactgtgattctggagggatagcagtgaatgaaaatcctgccctcatggaacttacatttgatttagggaaaccaggcaggcatgttttctttcaatgtgatgaacgctgtgtggagaagttacaggagcggttcaaatgtaaaacaggggacttgacctagtttaggggctgaagaaggcctccttgtaggagaatattgaagccaacctgcaagataaataatagctgtttgcagaatgtagggaagagctttccaggcagagagaacagcatgtgagaggcctagaggtaagtgcaggcctggggaactgggactagcttcagttatttggaacctagcatgtaatgcagagaatattgaaggataaggccagagagttaggtccaagtgagttcctaaggccttgaagccatgccaaggttctcatctctgtcagccagcactattgaaacaattctttaatgaggtaggtaacctttataaggcttccaacacaatgccaggcacaaaacagttgcctaagagttgctgttagtttctcttatcaacagcctcctgcagtgatctctccagtctcttctcccttccagtctgtcttaagtactgatgccagagaggtctgcctaagctcagtgctgtcatttcactccctgtttggagccatgagtggccccctgttgccttcaagactgaagccatccccatccttcctcccaccaacctagaggctttgcttcgtaaatgctggccctttccttcatgggctccaccctctgagtgtgtcatgaactcttccacttccttgccttggttcgtattgggtcctctgcccgaggtcagagatttggacgagcccttctcctccatcttcacagtctccatttaccattagatgccaggcccagacagttgatgaaaaatgtaagaaacggacccaagtataagaaaaagctagatctgtccattttatttctagtttttggaagagatgtggatacagagaaatattactctactattgaaaaaaatatatatcagtctgattataaatgtcaactcatactaagtcaatatcagggaagcagtgtggagaaggatgtggcaaactggagattgctgtttccatagaaagagggcagctaatgcttatctccagaccattgttatgcagtaatgtagactccatttcaccagatttaattcttaaggagaaactggaaacttgtattattatttgattattacttttggcagttaattttaaaaatcaccgtttaggccaaaacaacatgacatttgtctgggctacaagggactcttagcgactcttagcttgcacttacctttctaatctcagggctttttacaaagcccttctctgaattccctgaagatatgctagcttgaaggctcactgcatactctcaacttcccagccacttccctgtttccctcttataccagttaatactttgatgttattttttcagtcctatttaatcttttagactggaggttccttgagggtggggcctaattcttgtttttatcttccccatagcaattatcaagttatctgctccctttggcacctaagaaatattagttggggtgataactgaatggctgtccttctgccttcgttactgcttttgtggatgttattttctttgacccctattccacccgtgtgcagtggagaggatgggtgttgtattttacagaggaaggaattaactgagacgcaacaggatgatgggaacttctcaaggtcatgtggcaaggaagtcaaggaattggggtttgaacccaagtcgtctcagttccattccattgtcctctaccccctgccacctctcaccttcttccctttcacctttttctgtagctgaacggaaaccaccgctctttaacatgaatgcgatgagtgccttataccacattgcacagaacgaatcccccgtgctccagtcaggacactggtgaggactgagattccgaatctgggcccaggcgttaggccatggggtatggatgcctgactcatgccttccccacccctctcccaccctcctgtgactttcaggtctgagtacttccggaattttgtcgactcctgtcttcagaaaatccctcaagacagaccaacctcagaggttctcctgaaggtgagggcctgctggcctagcattctcctggaactgtagcttgttacagccacaagaacccccagggaaattagtggttcccagttcctcctccaccaagagcttcgttgatgaattcccaccccatccccaatgcctagtggactctgtgttttacaagattttgtctaccagactgccttaatttattaagtaataaactgttttcccttcttttattaatcaaagatttatataattgccagccagagcttctggtcagcatgtgataaccagggttgccccactgatctgatgtaatgcaagccaaaagcctgtgtagccttatcatgggtaaatgtatgatttcccttaggtgttttttgaattatcaaaaatggaggggccccattcccttcacagacccatgggggcctgaggagccgtagttggaaacttcagattatgtagttggacccacttgttttataattgtaggatactgtatgaagcccagaggggcctcatgacatgtccaaggtcacatagccctttagtagaggagctggacgagaatccagttctcctgactgtccctgcctgtcagccatgcttagaggaagaagagtctgtctggggagtaggtactgggtggtacagaaaattgtgagagaagggcttgggataaggccagcatcaacccgtggtgggcgtgggccccagaagagtgcctcaggcctgagggaatgccaagggctgtgggttgtggggggaaggggagttggcagcagacctcagtgccctcttcccccagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggtgacccagcttgccctaacacccctctttataccccatgtgtgcctgccccctgcagttgcttggccccttccccagccctactcacaccaccatcttcccatgctacctccatgcatatgccccagggcttccccttccctgtccagcagcctacgccctgttcgcaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccggtacacagctcacccttgggggacccgagccacctgctctagaactgcctgggtcttcgccctccttccctaagtgcagcactcctctgagtctgattggctgtcctcaggtagctctctttggacccagtggcctctgagccttgggtgttccttctatctccctctagggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtgagtgtagccatcctcactcagcctgctcgctgtctgttttttaagtctttttaagtctagaaatgatttcctccctgtggcatgggattgagtctggattctaccctcattttctgttgctggctcctgcctgctccccttaaccctcctgcttccctcctcttcccagtggactgttttggtcatatggcccaatctgggtgtttctagcttggcaaactcttactccgtttttgtggcctgacttaactgacatctcctgggttgccttcccaggctcctctggtgagtcagatgcttcacagttgtgtgctggggaagcccagtgctgggggagccctgtgcctgtggagccctgtgctgggggtgtccagtgctggggagccctgtgccgggggtgccctgtgcttgggtggtcctgaacagcatcatgataggtttgccagattctgtgccccagagggcagggatggtgttcagatatctgtctcatgccagcagttagctctcaggcttacacacaggcctgtgttaaccctcccagcccccctgggaggggaagggtaagatcccattggagaaatgaggcacctgtggctcagaggggccacttgccccagtgcctttggtggctctctgctcctgtaagcaggcccttagtcctctcctaaaatcaactcatggcagtctttctcagttcacaggaaaaagtgtttaggcttttcataaaacatagtttttcatctatgtttttagatcacgttcctgctgagctgcatttgagcgtcaacaatccccttagaggccactgattaagtctagtatgttcttatggcctctgcttggtgctggttgtgttccaacaattcttcagatcccatggtgttgtgcggtactgtgctgagaggtcttgactgccaggggcttggctgccgggactagtttgagagccactcatagagtcaattgagaatgagacctgagatcagactttggatgaaggtgtccaagcccagtgttcttgttattccagcatcttgtggccccgatcccacctcaatacctggggagtgataggccgaccatgtttgctgaaggggaaggaagccaacacttattagatagagtccgaacttaccccacagcccctatgaggaggtattatttccccatttaacagatgagggaactggtgctttgagaagttaacttacttgagatcacatgcttggtaagtggcaaagctgggatttgatcccaggtatgtctgactcactgtttcaaattagtatggattgttcctacttttgtgccaggccctgtgctcgccaccttttatcattcggccacaccaacttgtgatgtagataatatcaccattatccagttgaggaaacaggctagagtggccgtgtgtgaggaaggtgttaaatgagaatgaaacccatgagttgaaaacccatgctcttccccacggaagaccccttgtgttaattaactaggggccaggctgagccccagctctcaccctctctccttccccaggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggtgagctagggctgcttgggggcggagccgatggcgagccaggtgggtcctgaccctgcttccctctgcactcgcccaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggtaggcatcccaatctctgttcccctcccgctcactcgtggatcccagggacccacccttttccattttcctcattcttgtcttctttctccttggccctcgagtgttacagttcagctttgcttcagtgccccttttacttctcatccccaacagaccctgccagaatttccttaggcctcttttcccaggccagggaggagcttgcctcccctacaccctcatctcctgccatccccagctccctctgccaaggagccctggcccctcacttccttgatactgaccaggccctgggccctgtgtttcttccgccatccccagctccctctgccaaggagccctggcctctcacttccttgatactgaccaggccccgggccctgcatttcttctgcctcaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtgcctttgg

SEQ ID NO: 1309 - DNA, 18360 bp, Homo sapiens
gagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggtgagacacggggtgcaggggcgcgggtccctgtgtctagttctgagaagaaagggtgcgcctttctgagaagctggacttgggtaggccctctcaggatggggaagcccagctgagcgagtggtcagcctctggctagccttgccttctgttgccacccccttccccttcctcttcccttcattgtgtctggttggtgggggacctcaggtgacagggtctctgatgtcaccggcgttcacaccctagggtgcttcagctaatcagatggatttgcacttcagtcttctctccttcactttgcccctcacagccacctctcctccctgatatgtcccgttctcctggctattctgtggttttgattcccatgcctctgattcccatggtgggtctgcttatctgcttttcaggcctggtctggttggatttcttgtccttgcaaggaagtgtgtgtatatgtgtttgtgtgtatgcgtgtgtgtgtgtgcttggaggtgcctggcaatgttttcccccagctgcagttaccttccaacctcttgctgtgatggtgtcaataatctcatccatttgtcaaacgatctgtcttttacaaagtgctttgacagccattctctcatgtgacatccccgcattcaccctgtgggggcctcttttattggcatcttcccattttacagttgagaacgttgaggccgagagaggttgcccaaggtcacacagtggcagaaccagaatttgaactcaagtcctcaatcacatctttccctgatgcatgcctggttcttgccatctcttttcctctgagtttgggctcggccaggggtccctaggagtccaggctggggtgaggtttaagaatggggatgagatgagcttcctttccaggagggctctactcagaagcttttcctgatgggagcctctggcttttgcctctgcctcatggagttttctatccactgtgaccttcatctttaccccaatcccagggtttggcctggattcctgagagggctctctcctgacaaatggtagcactagtggcatcttttaactgttcaagccaagctgttggggtagaatgatcccccaaaggattaaagctttgtggggaccttggaggcagggaaggaaaaatccatatgctgagtgtctgcatggtgttcctaagtatgagatctcattaaaatcttaacaacagctccatgctgtaatccatttcactgaagagaagaccaagaactggaaggaacttatttaaagccctgttgctgtacattgcagacgggatgtactggtagcatagcttaggaacagatagatacgggtttcctcatctgtagaatggagataacattgttcgttttggaaggtggttatgatttagcacagaccttggttattgttcaagtgtttgttgttattatggggaaggggacctgcatgatgttttgccagtgggtggcacccctccgtgtggcctaggttagcattctggggccttgtgttggtaaagaggtcaggaagattcctttggcaagttgagagcacctgcctttgtgtgtgggtgtgtggtgctggtgaggggtgcttggcactgttgctggcagaagggagaaaagggccggctttgagcaacctgcgagctgctgagggctgagcagagagcaatcactcagtctcccaggctattctgagccctctgcaccctgggggcccactggagagtcaggctccctccttgccctccagcttccagttgggctgagacaaaattaacaacacaacaggaaacaatgcatgacagaataaattacatgctaaaattgttaggtgcttttgagtagctagaactctgccccaggagtccagctctgctgaaggctcctttgtgcctaaattctgacaagtgcttaggctggagcctgtcttggaatctccttgagggttttggttctggtatcctgcaggaactttctccgggtgtttggttgggtgccctaggtgctcttcccaatggctggagtggtcaggacaggcttcctgcaagaggggagctgagcttggggtgacagctgagagagtaatggatacaggcctaaccggggagccgaaggtcctgttctctgaccttggagaagtcctttttcttctctgtgcctcagtgacctcacctaggaaatggtgatcatgattctgccctgcctgtttcgaagggctgctctgaaatcatagtgatggaggaccagctttggacaaggcacttaaccttgctgagcctgtttctttatctgtaagataggggaaatcatagtacttgcttcataaggttgtagtgaggactgaatagagataatgcacgtaaggtactcagtaaatgttatttgtaccctgcaaatgtcctgtacctgtgtgtgatgcttatgcagttggacaggacaagtaaggtggcccagagcacagagaggccctcatagccagatgccatttatatccctattcttcccattctagatctccccctgacttttttgagagtgactttgcgggctcctctgggccagtacccacttctaacaatggacggatttccaccgcctccggcctggccatttcctgttctcttccagggtgtgagaggttgagggaggagggggcctcagcgccaaggggaacagaaaggtgcctggaaacagttggggtataggacttatgggacaggacacttggggctctggagtgctggctgggaagcagaatgttttatccttgaggggagatacaggggctatagggaaatgagaacttgttgagcactgaagggggtggtgaggatacttagcttcccagaatcttcctagcagttttagggactccagggacccagcccgcgtgatctggttgccagggcaacttcattttttggagctttgatgttgttcctaatctccccctccccttcctcagcagtgcctcctcctcatcagggaatgaggggaggagatggcagaaacttgatgggtcccttcctctccctgaaggctcaatccttgatctctaagggtcccatttccattcctcaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgtgagttgggtcttgggagggtgtaatagggatggggactcttcctatccctgtggacttcccaacagcccttgcacactactccatcacactggtctttcctgccttctcttgctgggccagcaagtcttcccatgcccggctctcaatggggccttcaacaccttctggtctggtcctctaggcccgggatgtccggaatagtgaggtggtggccatcaagaagatgtcctacagtgggaagcagtccaatgaggtgggccaggtgcaatacagccaggttggggacaggggactcctgtctcaagatgcaagctgggtaacctctgcctaccctgaccccctagaaatggcaagacatcatcaaggaggtgcggttcttacagaagctccggcatcccaacaccattcagtaccggggctgttacctgagggagcacacggcttgggtgagctggtgccagattctggcctgatctttactcctattcatgcccgtccttatcgtagtccagtctcttaggtggtccctgttcgtggtgctgttgtgggatcttgggaaggaggaagtctcttttgaccgctttagtcctcagacatacccactgagcaaaagcctggctcagtgacacaggctgttagcaggtgggacaggtcactgtgggctggagaaggtggagattgaatgggagtttgaagggattcagatgggcagtggtgaatgtcttgggcccagactctagaaactctcccaccaccccctcattgtctccagttgcgcttcctccctgtcatcaccccggggacatagcttgagtacaggacagtcaaggaagctctgttttgagtccctgcccaggagactctgatctctgacccttgtctcttccttagctggtaatggagtattgcctgggctcagcttctgaccttctagaaggtaagtgactgataggccaataagtggagaagggagaagagcaggggagccatagggaagggttaaggggagtttattccagtcccacccttgcgctccctcgggttgatgttcttcctcactctccagtgcacaagaaaccccttcaggaggtagagatcgcagctgtgacccacggggcgcttcagggcctggcatatctgcactcccacaacatgatccataggtacaagcagcaccggcagtgcctgggaggggagtgctatctgcaccacctgtcacttagctgggctgcccctgcctagctttcttgagacacatgtctcatccctgtactttgcctctggcagggatgtgaaggctggaaacatcctgctgtcagagccagggttagtgaagctaggggactttggttctgcgtccatcatggcacctgccaactccttcgtgggcaccccatactggtgagtgagtgagtggtggtgagtggagagacctcccagggatgttgggagtaggagtgacagggtctcggcgggtgatttgcctctctctcctgaccattctcctaggatggcacccgaggtgatcctggccatggatgaggggcagtacgatggcaaagtggacgtctggtccttggggataacctgcatcgagctgggtaagaacatcctccctgttccctcatcatcttttccattctttcctgttagttcccagactccggactacccccttctcctagggatgggatcccaggcctccaagttcctgtccgttgtgactctaccctggagcccaatacaggcagctggcaaattctgccagctcttaggcctagagattttgtagcattcatctcttcctgtccactaccctggttctgaatcttttcttagtgcccaccatgtgctgtgccatggactgtgattctggagggatagcagtgaatgaaaatcctgccctcatggaacttacatttgatttagggaaaccaggcaggcatgttttctttcaatgtgatgaacgctgtgtggagaagttacaggagcggttcaaatgtaaaacaggggacttgacctagtttaggggctgaagaaggcctccttgtaggagaatattgaagccaacctgcaagataaataatagctgtttgcagaatgtagggaagagctttccaggcagagagaacagcatgtgagaggcctagaggtaagtgcaggcctggggaactgggactagcttcagttatttggaacctagcatgtaatgcagagaatattgaaggataaggccagagagttaggtccaagtgagttcctaaggccttgaagccatgccaaggttctcatctctgtcagccagcactattgaaacaattctttaatgaggtaggtaacctttataaggcttccaacacaatgccaggcacaaaacagttgcctaagagttgctgttagtttctcttatcaacagcctcctgcagtgatctctccagtctcttctcccttccagtctgtcttaagtactgatgccagagaggtctgcctaagctcagtgctgtcatttcactccctgtttggagccatgagtggccccctgttgccttcaagactgaagccatccccatccttcctcccaccaacctagaggctttgcttcgtaaatgctggccctttccttcatgggctccaccctctgagtgtgtcatgaactcttccacttccttgccttggttcgtattgggtcctctgcccgaggtcagagatttggacgagcccttctcctccatcttcacagtctccatttaccattagatgccaggcccagacagttgatgaaaaatgtaagaaacggacccaagtataagaaaaagctagatctgtccattttatttctagtttttggaagagatgtggatacagagaaatattactctactattgaaaaaaatatatatcagtctgattataaatgtcaactcatactaagtcaatatcagggaagcagtgtggagaaggatgtggcaaactggagattgctgtttccatagaaagagggcagctaatgcttatctccagaccattgttatgcagtaatgtagactccatttcaccagatttaattcttaaggagaaactggaaacttgtattattatttgattattacttttggcagttaattttaaaaatcaccgtttaggccaaaacaacatgacatttgtctgggctacaagggactcttagcgactcttagcttgcacttacctttctaatctcagggctttttacaaagcccttctctgaattccctgaagatatgctagcttgaaggctcactgcatactctcaacttcccagccacttccctgtttccctcttataccagttaatactttgatgttattttttcagtcctatttaatcttttagactggaggttccttgagggtggggcctaattcttgtttttatcttccccatagcaattatcaagttatctgctccctttggcacctaagaaatattagttggggtgataactgaatggctgtccttctgccttcgttactgcttttgtggatgttattttctttgacccctattccacccgtgtgcagtggagaggatgggtgttgtattttacagaggaaggaattaactgagacgcaacaggatgatgggaacttctcaaggtcatgtggcaaggaagtcaaggaattggggtttgaacccaagtcgtctcagttccattccattgtcctctaccccctgccacctctcaccttcttccctttcacctttttctgtagctgaacggaaaccaccgctctttaacatgaatgcgatgagtgccttataccacattgcacagaacgaatcccccgtgctccagtcaggacactggtgaggactgagattccgaatctgggcccaggcgttaggccatggggtatggatgcctgactcatgccttccccacccctctcccaccctcctgtgactttcaggtctgagtacttccggaattttgtcgactcctgtcttcagaaaatccctcaagacagaccaacctcagaggttctcctgaaggtgagggcctgctggcctagcattctcctggaactgtagcttgttacagccacaagaacccccagggaaattagtggttcccagttcctcctccaccaagagcttcgttgatgaattcccaccccatccccaatgcctagtggactctgtgttttacaagattttgtctaccagactgccttaatttattaagtaataaactgttttcccttcttttattaatcaaagatttatataattgccagccagagcttctggtcagcatgtgataaccagggttgccccactgatctgatgtaatgcaagccaaaagcctgtgtagccttatcatgggtaaatgtatgatttcccttaggtgttttttgaattatcaaaaatggaggggccccattcccttcacagacccatgggggcctgaggagccgtagttggaaacttcagattatgtagttggacccacttgttttataattgtaggatactgtatgaagcccagaggggcctcatgacatgtccaaggtcacatagccctttagtagaggagctggacgagaatccagttctcctgactgtccctgcctgtcagccatgcttagaggaagaagagtctgtctggggagtaggtactgggtggtacagaaaattgtgagagaagggcttgggataaggccagcatcaacccgtggtgggcgtgggccccagaagagtgcctcaggcctgagggaatgccaagggctgtgggttgtggggggaaggggagttggcagcagacctcagtgccctcttcccccagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggtgacccagcttgccctaacacccctctttataccccatgtgtgcctgccccctgcagttgcttggccccttccccagccctactcacaccaccatcttcccatgctacctccatgcatatgccccagggcttccccttccctgtccagcagcctacgccctgttcgcaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccggtacacagctcacccttgggggacccgagccacctgctctagaactgcctgggtcttcgccctccttccctaagtgcagcactcctctgagtctgattggctgtcctcaggtagctctctttggacccagtggcctctgagccttgggtgttccttctatctccctctagggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtgagtgtagccatcctcactcagcctgctcgctgtctgttttttaagtctttttaagtctagaaatgatttcctccctgtggcatgggattgagtctggattctaccctcattttctgttgctggctcctgcctgctccccttaaccctcctgcttccctcctcttcccagtggactgttttggtcatatggcccaatctgggtgtttctagcttggcaaactcttactccgtttttgtggcctgacttaactgacatctcctgggttgccttcccaggctcctctggtgagtcagatgcttcacagttgtgtgctggggaagcccagtgctgggggagccctgtgcctgtggagccctgtgctgggggtgtccagtgctggggagccctgtgccgggggtgccctgtgcttgggtggtcctgaacagcatcatgataggtttgccagattctgtgccccagagggcagggatggtgttcagatatctgtctcatgccagcagttagctctcaggcttacacacaggcctgtgttaaccctcccagcccccctgggaggggaagggtaagatcccattggagaaatgaggcacctgtggctcagaggggccacttgccccagtgcctttggtggctctctgctcctgtaagcaggcccttagtcctctcctaaaatcaactcatggcagtctttctcagttcacaggaaaaagtgtttaggcttttcataaaacatagtttttcatctatgtttttagatcacgttcctgctgagctgcatttgagcgtcaacaatccccttagaggccactgattaagtctagtatgttcttatggcctctgcttggtgctggttgtgttccaacaattcttcagatcccatggtgttgtgcggtactgtgctgagaggtcttgactgccaggggcttggctgccgggactagtttgagagccactcatagagtcaattgagaatgagacctgagatcagactttggatgaaggtgtccaagcccagtgttcttgttattccagcatcttgtggccccgatcccacctcaatacctggggagtgataggccgaccatgtttgctgaaggggaaggaagccaacacttattagatagagtccgaacttaccccacagcccctatgaggaggtattatttccccatttaacagatgagggaactggtgctttgagaagttaacttacttgagatcacatgcttggtaagtggcaaagctgggatttgatcccaggtatgtctgactcactgtttcaaattagtatggattgttcctacttttgtgccaggccctgtgctcgccaccttttatcattcggccacaccaacttgtgatgtagataatatcaccattatccagttgaggaaacaggctagagtggccgtgtgtgaggaaggtgttaaatgagaatgaaacccatgagttgaaaacccatgctcttccccacggaagaccccttgtgttaattaactaggggccaggctgagccccagctctcaccctctctccttccccaggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggtgagctagggctgcttgggggcggagccgatggcgagccaggtgggtcctgaccctgcttccctctgcactcgcccaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggtaggcatcccaatctctgttcccctcccgctcactcgtggatcccagggacccacccttttccattttcctcattcttgtcttctttctccttggccctcgagtgttacagttcagctttgcttcagtgccccttttacttctcatccccaacagaccctgccagaatttccttaggcctcttttcccaggccagggaggagcttgcctcccctacaccctcatctcctgccatccccagctccctctgccaaggagccctggcccctcacttccttgatactgaccaggccctgggccctgtgtttcttccgccatccccagctccctctgccaaggagccctggcctctcacttccttgatactgaccaggccccgggccctgcatttcttctgcctcaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtgcctttggcccaggctgcctctgtctgctttgtcctgccgcctagcctccccggtatgcccccaggctgaccctcggcccggctccatgacctcttcaccccatctccgttatctcagccccctcactcctccagcctcatgctctctgccttcatagcttcattgcaccatgaccaccaccggctctggggtctgggcccctgtagaacttcaccgaacttcttggtcccacagagcgcctgtttgcgggttccttccagaggtcttagtttccaggcccttggtctcctcatcccttgccttttctcccaaccatggctgcaggggaccaaattgctctcctgcatcaggcattaccctagtgggttgggggacggggctgcagaccctccacagtagggggtgctgagctgggggcaaccaggcggagtatgaaggctgtggcagcaggattgagtgtgggcctggagtgggagctgagtgtgtgaggggccgggctggaatgcggatctggtcagggtggtagctgctggccggttgaacttgtcaggccctttctggccacctcctttgcccctttctcctctgcggcccaaaatggggcagccccttcttacccatttctcagctcggtgcttctcctccttccctgccttcctccctgagctgctggacctgggacttcctgtgtctgtccttagtcgtgttgctttcttcatgggtgttttgtgtgactggttcttctcgcttgttctcgtgcacgttctcatatttgctcacgtgcttctgtctctaggtcacagtctctccctctttgcctggtcagagcttccaagatcctcagttccctgtccagtaactccgatgttctttctcgtgggtatcgcacccaactccgtgcacgtgctcttggaacctcttgtcttctctgcatctcttgcccatcgagaccttcctgatctctctcaacacgatcccacctctccatgtctgtctgtctgtatacagctccccccaccccctctgtctaacatgttttctgtttctctccctctccctgtctctgcttctgtctcctctcctcttctctctcttctccccatttcccctggttgttcctcctcttcctcttcctcctcttcctcctcctcttccccgctgcccccatctccccttgatccgtccactgcatagtctaaggagctgcagatcaagaagcagttccaggagacgtgtaagatccagactcggcagtacaaggctctgcgagcacacttgctggagaccacgcccaaagctcagcacaagagcctccttaagcggctcaaggaagagcagacccgcaagctggcgatcttggcggagcagtatgaccagtccatctcagagatgctcagctcacaggcggtgaggcctggggtccagggagggagtgcgctagaggccaggctctgtactttgctttagagaaatggacggtgcagggcatgcacagagctggggcttttttacttgggaaactcacatactctccctctgttcgtgttctccacaatgatttatttcatattctcctcagtggttttattctttctcttagtattttcttaaggtcttgacaaagccatgtgcctattcccaagaaccaccaaggaaaagagtggctattatttttttcctgggcctgagttagtttaatgggtaaacagggtgcagattaaagtgagtgtggccctcaagcccatttactcagacttctggaggattttgaaagttgctgttctaaaaaaatgatcacacctaacactggaatgggccacttaaaatgtgcggagagggtggagagtggaaacgccccacccaaggctgttctctcacccagtcccacctctcccaggtaacttgttaataattaactgtattttgtgttttttcagtgcacattttgaaaaattatatgaattttaaacacagatggaatcatactttacatttactttctgtaacttcttttttccacttaatatttcttggacatcttcccctgtcagtacacctgtctcattttttttacagcatagaattttccatggtatggctgtaccataatttatttaacccatcccttattggtggacatttaggttgtttccagtattttgctatcacaacgcttccgtgaacacctcgagcacatgtgcaagtatacctgggggatagattctgcagtgtaattgctgtgccacagggtatgaccatcttccattctgatagatgttgagaccgctgcttcttgaaaccttagggcccaggcctacctggggcaggggaggatagtgggggtgggggaggagatccctacaactggttgttcatcttccccagctgcggcttgatgagacccaggaggcagagttccaggcccttcggcagcagcttcaacaggagctggagctgctcaacgcttaccagagcaagatcaagatccgcacagagagccagcacgagagggagctgcgggagctggagcagagggtcgcgctgcggcgggcactgctggagcagcgggtaaggggcccagcctccaggactggggagggagggtgggctcctgcccccgactctaacctctgttccggatgccccaggtggaagaggagctgctggccctgcagacaggacgctccgagcgaatccgcagtctgcttgagcggcaggcccgtgagatcgaggccttcgatgcggaaagcatgaggctgggcttctccagcatggctctggggggcatcccggctgaagctgctgcccagggctatcctgctccaccccctgccccagcctggccctcccgtcccgttccccgttctggggcacactggagccatggccctcctccaccaggcatgccccctccagcctggcgtcagccgtctctgctggctcccccaggccccccaaactggctggggccccccacacaaagtgggacaccccgtggcggagccctgctgctgctaagaaacagcccccagcccctgcggcgggcagcctcggggggcagtggcagtgagaatgtgggcccccctgctgccgcggtgcccgggcccctgagccgcagcaccagtgtcgcttcccacatcctcaatggttcttcccacttctattcctgaggtgcagcggggaggagcagatgagctgggcagggcaggggtgggtggagcctgaccctggagggcactgagctggaggcccctgcaagggtaggggacaagatgtaggctccagctcccctcagacctcctcatctcatgagcttcttggggctggccagtggcccagggccagcttggcgataggtgcctcaaggctgcctgggagccccgcctccctaccatggtgccaggggtctccctccgccacctaggaaaggagggagatgtgcgtgtcaaatattcatctagtcccctgggggaggggaagggtgggtctagacatactatattcagagaactatactaccctcacagtgaggccctcagacctgccacagggcagagcaggtctggggcctgaggcagggagaatgagaggccaccttactggcaggaaggatcaggatggggtcttggggtcaggatgcctgggtctcttcccgtaactgtctgacgtcctgtgccgtcttgtcctttatctttttttttttttttttaattgggatcagggctggggcggggaaacaagggaaggaccttggaaggggctgctcccaggcctggggggcagtcgtgggagcccctctcagctgtggggctggcacagagccccaggcaagcttttaataaactgttggttattctaacag

SEQ ID NO: 1310 - DNA, 14498 bp, Homo sapiens
gagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggtgagacacggggtgcaggggcgcgggtccctgtgtctagttctgagaagaaagggtgcgcctttctgagaagctggacttgggtaggccctctcaggatggggaagcccagctgagcgagtggtcagcctctggctagccttgccttctgttgccacccccttccccttcctcttcccttcattgtgtctggttggtgggggacctcaggtgacagggtctctgatgtcaccggcgttcacaccctagggtgcttcagctaatcagatggatttgcacttcagtcttctctccttcactttgcccctcacagccacctctcctccctgatatgtcccgttctcctggctattctgtggttttgattcccatgcctctgattcccatggtgggtctgcttatctgcttttcaggcctggtctggttggatttcttgtccttgcaaggaagtgtgtgtatatgtgtttgtgtgtatgcgtgtgtgtgtgtgcttggaggtgcctggcaatgttttcccccagctgcagttaccttccaacctcttgctgtgatggtgtcaataatctcatccatttgtcaaacgatctgtcttttacaaagtgctttgacagccattctctcatgtgacatccccgcattcaccctgtgggggcctcttttattggcatcttcccattttacagttgagaacgttgaggccgagagaggttgcccaaggtcacacagtggcagaaccagaatttgaactcaagtcctcaatcacatctttccctgatgcatgcctggttcttgccatctcttttcctctgagtttgggctcggccaggggtccctaggagtccaggctggggtgaggtttaagaatggggatgagatgagcttcctttccaggagggctctactcagaagcttttcctgatgggagcctctggcttttgcctctgcctcatggagttttctatccactgtgaccttcatctttaccccaatcccagggtttggcctggattcctgagagggctctctcctgacaaatggtagcactagtggcatcttttaactgttcaagccaagctgttggggtagaatgatcccccaaaggattaaagctttgtggggaccttggaggcagggaaggaaaaatccatatgctgagtgtctgcatggtgttcctaagtatgagatctcattaaaatcttaacaacagctccatgctgtaatccatttcactgaagagaagaccaagaactggaaggaacttatttaaagccctgttgctgtacattgcagacgggatgtactggtagcatagcttaggaacagatagatacgggtttcctcatctgtagaatggagataacattgttcgttttggaaggtggttatgatttagcacagaccttggttattgttcaagtgtttgttgttattatggggaaggggacctgcatgatgttttgccagtgggtggcacccctccgtgtggcctaggttagcattctggggccttgtgttggtaaagaggtcaggaagattcctttggcaagttgagagcacctgcctttgtgtgtgggtgtgtggtgctggtgaggggtgcttggcactgttgctggcagaagggagaaaagggccggctttgagcaacctgcgagctgctgagggctgagcagagagcaatcactcagtctcccaggctattctgagccctctgcaccctgggggcccactggagagtcaggctccctccttgccctccagcttccagttgggctgagacaaaattaacaacacaacaggaaacaatgcatgacagaataaattacatgctaaaattgttaggtgcttttgagtagctagaactctgccccaggagtccagctctgctgaaggctcctttgtgcctaaattctgacaagtgcttaggctggagcctgtcttggaatctccttgagggttttggttctggtatcctgcaggaactttctccgggtgtttggttgggtgccctaggtgctcttcccaatggctggagtggtcaggacaggcttcctgcaagaggggagctgagcttggggtgacagctgagagagtaatggatacaggcctaaccggggagccgaaggtcctgttctctgaccttggagaagtcctttttcttctctgtgcctcagtgacctcacctaggaaatggtgatcatgattctgccctgcctgtttcgaagggctgctctgaaatcatagtgatggaggaccagctttggacaaggcacttaaccttgctgagcctgtttctttatctgtaagataggggaaatcatagtacttgcttcataaggttgtagtgaggactgaatagagataatgcacgtaaggtactcagtaaatgttatttgtaccctgcaaatgtcctgtacctgtgtgtgatgcttatgcagttggacaggacaagtaaggtggcccagagcacagagaggccctcatagccagatgccatttatatccctattcttcccattctagatctccccctgacttttttgagagtgactttgcgggctcctctgggccagtacccacttctaacaatggacggatttccaccgcctccggcctggccatttcctgttctcttccagggtgtgagaggttgagggaggagggggcctcagcgccaaggggaacagaaaggtgcctggaaacagttggggtataggacttatgggacaggacacttggggctctggagtgctggctgggaagcagaatgttttatccttgaggggagatacaggggctatagggaaatgagaacttgttgagcactgaagggggtggtgaggatacttagcttcccagaatcttcctagcagttttagggactccagggacccagcccgcgtgatctggttgccagggcaacttcattttttggagctttgatgttgttcctaatctccccctccccttcctcagcagtgcctcctcctcatcagggaatgaggggaggagatggcagaaacttgatgggtcccttcctctccctgaaggctcaatccttgatctctaagggtcccatttccattcctcaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgtgagttgggtcttgggagggtgtaatagggatggggactcttcctatccctgtggacttcccaacagcccttgcacactactccatcacactggtctttcctgccttctcttgctgggccagcaagtcttcccatgcccggctctcaatggggccttcaacaccttctggtctggtcctctaggcccgggatgtccggaatagtgaggtggtggccatcaagaagatgtcctacagtgggaagcagtccaatgaggtgggccaggtgcaatacagccaggttggggacaggggactcctgtctcaagatgcaagctgggtaacctctgcctaccctgaccccctagaaatggcaagacatcatcaaggaggtgcggttcttacagaagctccggcatcccaacaccattcagtaccggggctgttacctgagggagcacacggcttgggtgagctggtgccagattctggcctgatctttactcctattcatgcccgtccttatcgtagtccagtctcttaggtggtccctgttcgtggtgctgttgtgggatcttgggaaggaggaagtctcttttgaccgctttagtcctcagacatacccactgagcaaaagcctggctcagtgacacaggctgttagcaggtgggacaggtcactgtgggctggagaaggtggagattgaatgggagtttgaagggattcagatgggcagtggtgaatgtcttgggcccagactctagaaactctcccaccaccccctcattgtctccagttgcgcttcctccctgtcatcaccccggggacatagcttgagtacaggacagtcaaggaagctctgttttgagtccctgcccaggagactctgatctctgacccttgtctcttccttagctggtaatggagtattgcctgggctcagcttctgaccttctagaaggtaagtgactgataggccaataagtggagaagggagaagagcaggggagccatagggaagggttaaggggagtttattccagtcccacccttgcgctccctcgggttgatgttcttcctcactctccagtgcacaagaaaccccttcaggaggtagagatcgcagctgtgacccacggggcgcttcagggcctggcatatctgcactcccacaacatgatccataggtacaagcagcaccggcagtgcctgggaggggagtgctatctgcaccacctgtcacttagctgggctgcccctgcctagctttcttgagacacatgtctcatccctgtactttgcctctggcagggatgtgaaggctggaaacatcctgctgtcagagccagggttagtgaagctaggggactttggttctgcgtccatcatggcacctgccaactccttcgtgggcaccccatactggtgagtgagtgagtggtggtgagtggagagacctcccagggatgttgggagtaggagtgacagggtctcggcgggtgatttgcctctctctcctgaccattctcctaggatggcacccgaggtgatcctggccatggatgaggggcagtacgatggcaaagtggacgtctggtccttggggataacctgcatcgagctgggtaagaacatcctccctgttccctcatcatcttttccattctttcctgttagttcccagactccggactacccccttctcctagggatgggatcccaggcctccaagttcctgtccgttgtgactctaccctggagcccaatacaggcagctggcaaattctgccagctcttaggcctagagattttgtagcattcatctcttcctgtccactaccctggttctgaatcttttcttagtgcccaccatgtgctgtgccatggactgtgattctggagggatagcagtgaatgaaaatcctgccctcatggaacttacatttgatttagggaaaccaggcaggcatgttttctttcaatgtgatgaacgctgtgtggagaagttacaggagcggttcaaatgtaaaacaggggacttgacctagtttaggggctgaagaaggcctccttgtaggagaatattgaagccaacctgcaagataaataatagctgtttgcagaatgtagggaagagctttccaggcagagagaacagcatgtgagaggcctagaggtaagtgcaggcctggggaactgggactagcttcagttatttggaacctagcatgtaatgcagagaatattgaaggataaggccagagagttaggtccaagtgagttcctaaggccttgaagccatgccaaggttctcatctctgtcagccagcactattgaaacaattctttaatgaggtaggtaacctttataaggcttccaacacaatgccaggcacaaaacagttgcctaagagttgctgttagtttctcttatcaacagcctcctgcagtgatctctccagtctcttctcccttccagtctgtcttaagtactgatgccagagaggtctgcctaagctcagtgctgtcatttcactccctgtttggagccatgagtggccccctgttgccttcaagactgaagccatccccatccttcctcccaccaacctagaggctttgcttcgtaaatgctggccctttccttcatgggctccaccctctgagtgtgtcatgaactcttccacttccttgccttggttcgtattgggtcctctgcccgaggtcagagatttggacgagcccttctcctccatcttcacagtctccatttaccattagatgccaggcccagacagttgatgaaaaatgtaagaaacggacccaagtataagaaaaagctagatctgtccattttatttctagtttttggaagagatgtggatacagagaaatattactctactattgaaaaaaatatatatcagtctgattataaatgtcaactcatactaagtcaatatcagggaagcagtgtggagaaggatgtggcaaactggagattgctgtttccatagaaagagggcagctaatgcttatctccagaccattgttatgcagtaatgtagactccatttcaccagatttaattcttaaggagaaactggaaacttgtattattatttgattattacttttggcagttaattttaaaaatcaccgtttaggccaaaacaacatgacatttgtctgggctacaagggactcttagcgactcttagcttgcacttacctttctaatctcagggctttttacaaagcccttctctgaattccctgaagatatgctagcttgaaggctcactgcatactctcaacttcccagccacttccctgtttccctcttataccagttaatactttgatgttattttttcagtcctatttaatcttttagactggaggttccttgagggtggggcctaattcttgtttttatcttccccatagcaattatcaagttatctgctccctttggcacctaagaaatattagttggggtgataactgaatggctgtccttctgccttcgttactgcttttgtggatgttattttctttgacccctattccacccgtgtgcagtggagaggatgggtgttgtattttacagaggaaggaattaactgagacgcaacaggatgatgggaacttctcaaggtcatgtggcaaggaagtcaaggaattggggtttgaacccaagtcgtctcagttccattccattgtcctctaccccctgccacctctcaccttcttccctttcacctttttctgtagctgaacggaaaccaccgctctttaacatgaatgcgatgagtgccttataccacattgcacagaacgaatcccccgtgctccagtcaggacactggtgaggactgagattccgaatctgggcccaggcgttaggccatggggtatggatgcctgactcatgccttccccacccctctcccaccctcctgtgactttcaggtctgagtacttccggaattttgtcgactcctgtcttcagaaaatccctcaagacagaccaacctcagaggttctcctgaaggtgagggcctgctggcctagcattctcctggaactgtagcttgttacagccacaagaacccccagggaaattagtggttcccagttcctcctccaccaagagcttcgttgatgaattcccaccccatccccaatgcctagtggactctgtgttttacaagattttgtctaccagactgccttaatttattaagtaataaactgttttcccttcttttattaatcaaagatttatataattgccagccagagcttctggtcagcatgtgataaccagggttgccccactgatctgatgtaatgcaagccaaaagcctgtgtagccttatcatgggtaaatgtatgatttcccttaggtgttttttgaattatcaaaaatggaggggccccattcccttcacagacccatgggggcctgaggagccgtagttggaaacttcagattatgtagttggacccacttgttttataattgtaggatactgtatgaagcccagaggggcctcatgacatgtccaaggtcacatagccctttagtagaggagctggacgagaatccagttctcctgactgtccctgcctgtcagccatgcttagaggaagaagagtctgtctggggagtaggtactgggtggtacagaaaattgtgagagaagggcttgggataaggccagcatcaacccgtggtgggcgtgggccccagaagagtgcctcaggcctgagggaatgccaagggctgtgggttgtggggggaaggggagttggcagcagacctcagtgccctcttcccccagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggtgacccagcttgccctaacacccctctttataccccatgtgtgcctgccccctgcagttgcttggccccttccccagccctactcacaccaccatcttcccatgctacctccatgcatatgccccagggcttccccttccctgtccagcagcctacgccctgttcgcaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccggtacacagctcacccttgggggacccgagccacctgctctagaactgcctgggtcttcgccctccttccctaagtgcagcactcctctgagtctgattggctgtcctcaggtagctctctttggacccagtggcctctgagccttgggtgttccttctatctccctctagggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtgagtgtagccatcctcactcagcctgctcgctgtctgttttttaagtctttttaagtctagaaatgatttcctccctgtggcatgggattgagtctggattctaccctcattttctgttgctggctcctgcctgctccccttaaccctcctgcttccctcctcttcccagtggactgttttggtcatatggcccaatctgggtgtttctagcttggcaaactcttactccgtttttgtggcctgacttaactgacatctcctgggttgccttcccaggctcctctggtgagtcagatgcttcacagttgtgtgctggggaagcccagtgctgggggagccctgtgcctgtggagccctgtgctgggggtgtccagtgctggggagccctgtgccgggggtgccctgtgcttgggtggtcctgaacagcatcatgataggtttgccagattctgtgccccagagggcagggatggtgttcagatatctgtctcatgccagcagttagctctcaggcttacacacaggcctgtgttaaccctcccagcccccctgggaggggaagggtaagatcccattggagaaatgaggcacctgtggctcagaggggccacttgccccagtgcctttggtggctctctgctcctgtaagcaggcccttagtcctctcctaaaatcaactcatggcagtctttctcagttcacaggaaaaagtgtttaggcttttcataaaacatagtttttcatctatgtttttagatcacgttcctgctgagctgcatttgagcgtcaacaatccccttagaggccactgattaagtctagtatgttcttatggcctctgcttggtgctggttgtgttccaacaattcttcagatcccatggtgttgtgcggtactgtgctgagaggtcttgactgccaggggcttggctgccgggactagtttgagagccactcatagagtcaattgagaatgagacctgagatcagactttggatgaaggtgtccaagcccagtgttcttgttattccagcatcttgtggccccgatcccacctcaatacctggggagtgataggccgaccatgtttgctgaaggggaaggaagccaacacttattagatagagtccgaacttaccccacagcccctatgaggaggtattatttccccatttaacagatgagggaactggtgctttgagaagttaacttacttgagatcacatgcttggtaagtggcaaagctgggatttgatcccaggtatgtctgactcactgtttcaaattagtatggattgttcctacttttgtgccaggccctgtgctcgccaccttttatcattcggccacaccaacttgtgatgtagataatatcaccattatccagttgaggaaacaggctagagtggccgtgtgtgaggaaggtgttaaatgagaatgaaacccatgagttgaaaacccatgctcttccccacggaagaccccttgtgttaattaactaggggccaggctgagccccagctctcaccctctctccttccccaggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggtgagctagggctgcttgggggcggagccgatggcgagccaggtgggtcctgaccctgcttccctctgcactcgcccaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggtaggcatcccaatctctgttcccctcccgctcactcgtggatcccagggacccacccttttccattttcctcattcttgtcttctttctccttggccctcgagtgttacagttcagctttgcttcagtgccccttttacttctcatccccaacagaccctgccagaatttccttaggcctcttttcccaggccagggaggagcttgcctcccctacaccctcatctcctgccatccccagctccctctgccaaggagccctggcccctcacttccttgatactgaccaggccctgggccctgtgtttcttccgccatccccagctccctctgccaaggagccctggcctctcacttccttgatactgaccaggccccgggccctgcatttcttctgcctcaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtg

SEQ ID NO: 1311 - DNA, 6091 bp, Homo sapiens
ttcctgagcatggatggcttttgagttttattaacaaaaatactctggtcccagaacaacagactggtgtggcctgcaccagtgtgtgtgggggggtggggattgagcccctccagagcccatggggaggcctggtaagtggggatgctggtctgtggccccatttggccaggcagagccccttccattcacacggaggtgagagccgggaaggggaagccggccccagctggactcccagcagccttggttaggctttgaagccagaggggggtgggagtgaaatcaaggtgtgaagttgagggggtgggtgggcaggcccaaggcggccatttggtgtgggggatggggccggtggaggtgagggggctccagggctgggggaagggagcgggaggtttgtgatggaggcagaggggcccagcagtggttcagtacatgggtttggagcccacatccagatagcccccaggcgcggtgtatggtagagggaaggggcccccttggagaaagtgcggggcaaagggtaccgccggtggagccgctgggtacccggagccccctgacccgtgcggcagctccagaaatgcagccgagtagggggctgagcgcccggagtctggagcctccgggaagctggggctcctgacatggagagagggatgtcagagcagggcagagggacccgcagccccgcctggtcccctgtcccactcacctggtgggaaggtgactgggggccccatggaaagccgcagggtgcaggaggtaggcctcagcactggggccaccacacagaggtgccggggcagcggtggcttccccgggggctggggcctgttctggatctgattcacgaatgtctccacccagggtggagtcgcagggaccacctggtgtgtctggggagagggaagggagaggttgggctagggaggatccctgtctcaggcctggccccatcgccatcgggactacactcacctccgctcccataggcctctgtggctgctggctctgggccccgcagtttcctcttcacacgggcgtctcgctccctggggaacagtggtggtgatgatgatgatgatggtgatggccatggtgatggtaacagtacttacccggtgccaggcatttcaccctcccagggaccctgtcaggtaggggccatcattatacccattttatagatgaagaaactgaaggccagaaaattaaataactagaaagtggcagagctggaattttgtccctgctcaaatttgtccatgctttcctattgtgtttagtatcagtggaaactccttcccagtggcaaggccagggcacagtctcacctagctcatctttctgccccatctccactctcagcctctctctggaatcctcttctgtcccctcttcacgggctgaacctgtcctttttcttttcatttttaaaatttgagatggggtcttgctatgttgcccaggctggagtgcagtggcacagtcacaggtcacagctcactgcagcctccaactcctgggctcaagtgatctttccatctcagcctccgaaagtgctgggactacaggcatgagccaccaaacctatccttgcctcactgcaagcgcaagttcctcaaggaagtcctccctgacctccgagagcacacacccctccctcataacatccgtcacagttctgcttttgcatttgatggagtgactccttggttcatgtctgtctcttctgacaaactggaagctacttgagggcaggggccagctctgaggtgctgcacttggaacagttcccacggccttacggaacctttactgtccgacataacctggcttcccctcccctgcctgactcttagtcactccactgcagccacgccacaggcacagccccacctcagggcctttgcacgtgctgttcccactccctagtgtgctttgccagatgcccacctggctccctcccgtacttccttcagctctttctcaagtgtcttcttcccactgaggcctttccaggcctcttatctaatacctcaccccagtccttcctatcttttcctggtttatttctcttctcctttttcttttttttctttttttttttttttttgagacagagttttcttttctttctttttttttttttttttgagaggaagttttgctcgtgttgcctaggctggaatgcaatggcatgatctcgactcactgcaacctccacctcctgggttcaagagattctcctgcctcagcctcccaagtagttgggattacaggcgtttgccaccatgcctggctaatttttgtatttttagcagagacagggtttcaccatgttggcaggctggtctcgaactcctggcctcaggtgatctgcccgcctcagcctcccagagtgctgggattacatgcgtgagccaccacacctggtctctcttctctttagaatggcttcctaacagatgacattttatttatttctcttgtctgcttgtctactctccccactagaaatcagctgcatgagggccggggctttggtttgctttgtttgttttatctccagtgcctggaactgtccctggcacatagcaggtactatataagtatttgctgagtcagtgaatgaatgttttcacttaccactgcatttctgatgtccagcacggtgcctggcacacagtgagtgattaataaacatttgttgaatgcatgaacaaatgaatgaacaactcccacctcttacagtttctgccgttctcccggaagcctttggcaaagggattggctgcaatcttcagttgtgtgatctggggacacacatgcagggtcaaagcaactgcggtctgggcagggggccaccaccccctcaagcagggtcactcacctgtgggttctggtaggctgtcacggagatgaatgtggtctcggggaagcggaaggaggccatgcccccccagtgctggctgcagagctgggctgcccgaactaggtgtatgcggggttggtacttgtgcatggagtgcaggatcagctgggagggaggaaatgggagtgattccctgccctgcgcctcacccttggcctcccttccagcaccccccaaccctatcctggagtcccagcctgggcctcacgtggccgtgggggtccagcgtgctgttggtgagcttgacacgatggaaagacacaggctgccgcatccaatgtgcaccagtggcaggagagtcggggtgaatgtagacacggtcaggcaggcggggctctgccttgccgctgggctcccagcgccggccctgccagcggtagcgagccccatccaccggaatcacatccagaagaaacaagtagcgggcctcggggtccaggccagtgactgacactcggcaggcagggaacatgcgcctgtgcaagggaggggacaggagaggcctggagctacccactggccaggggtgggcccagcaccagtaacgggacataacaacgggctccccagagctgtcagagaaacatcaaaggaggtggaattagaacccagagggcaggctggaggctgtggctcacacctctaatccctatactttgggaggccaaggtgggaggatctcttgagtcaggaattcaagaccagcctgggcaacatagaaagaccccatctctacaaaaaaattaaaaaattagccaggcatggtggtgcacactgatagtcccagttactacagaggctgaggcgggagggtcacttgagcctgggaagtcaagactacagtgagccacaattgcaccactgcactccagcctgggcaacagggcaagacactgtctctgaaaaatgaaaaagggccaggcgcagtggctcatgcctgtaatctcagcactttaggaagccgaggtggaaggatcatgaggtcagaagtttgagaccagcctggccaatatggtgaaacaccgtctctactaaaactacaaaaattagccgggtgtggtggtgtgtgcctatagtcccagctactcgggaggctgaggcaggagaatcgcttgaatccaggaagcagaggttgcggtgagctgacgagatcgtgccactacactctagcctgggcaacagagcgagactccatctcaaaaaaaaaaaaaaaaaaaaaaagaagccagagggcggaatcttagagctggaaggttttcttgtctcattttacatttggggaaacaggacagacgggttaagtgatctgtcacacagcaggttaggaacagagccatgactcctacccctcaaagcctatttgcagaagcaggggtgactaactttcttgctaggagcttcctgtccccaccctcctctcctcccctgatctccagcaccagaatctgcagctcttagatgaatttgctttagaaaaaatataccctgcctgcagtagggccgaggactttccatgctagggcttgagttcctgccccagctaaagacctcatctaaggtcaaacactgaccgtgtccctgcctctagggtgaccctggacctagtcatatactgactcctattcgagttgcatactgatcccgaatcctggccagatttccctgatgctggtcaatgggctggcccttgaccccctgtccttgtctggatgctggtctaagccacacactaacctataacccagagggacttcctgaccctgccccagactgacccatgacccttgccatagattggtccctaaactcagccacagactccacagactggcccttaacccttgtcacagagtgactcctgattcctgccacagagtaacccttgccccaggccatagtcagattctaggcctaggcagagctctagcccctcgggaaccacccagtcctagccccctccccagggactctgcctttcccaagagacccccaccagaaacacggaccctggccagcccctcacctcccagctttggtgatgatcatttctgttcccacagagctgaactccttccatagctcccggttctccaggctcaggctgacccccgggagggaatggagggcctctggagctgatggggccggctcagtgcccatggcagggggcagaaggggcagaggtgggtgcgcggccagggtgcggggagcagcctccatcccggagaggaagcaatccagtttaggggtgtccagttctggaagccggggaagaatgaggagccagccgagggccacagcccccctattctcctacccaggagctggtcccaacgctcaccggggtagcggtagccctccgctagggcgggtgggaagctggagtcggccccaggttgggcgggccccaggcggtagccggcccccagggacgggtacaattctcgtggatggtacatgttgtagttccgtctggcctcaggtctcgctgcttagggcccccggtgctgcgagatgccccctttatagctcacagctcagccccttccagatccaggatcacagcccctcccctctttggggccctggagttgggctggggtggagacccctggggcctcgaaggggtccgagagggggtcggatacctgggtacggtcccctcctcccctccctccccaccccgggaggcttcattagcctcgaccccctgccccctcattacataattaactcctcggcttgattgatccccagggctcggacagggacgcagtttggcgcttccggccagctggtccccgttcccacggtggggagccccggctagggataagctggggggcggggcctggaacctggacggagccaagagtcccgggacacaccttggcgccccagaccttctggcaggtgaccgccctccgccccccttcacttggaggccgggccctggagggaagcagcgtgaacagagggaaagtgcaggctagagggacgcggcctgagctgatttcacagggcactcggggccgcgaggaggccgcagcccagtcccgagcaccgtagtcctccctggtccccatgctaaaaaaacctccatcccgagccaagcctccaaagttcgaaggcgctcacagtccgacagct

SEQ ID NO: 1312 - DNA, 11023 bp, Homo sapiens
gaggaggagggtcggggacggaagcgcagagcacggaccccgccccctcgcggccccgctcgtgacgtcgcggggggcgccggcctccgcccggccccgaggggtaagagcgagcggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctgagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggtaagttccccacccccgtacccgctcttccttccaacctagacaggcttttgctgctaatctcatctcacccgtcttcttttgctcacaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggtgagatcagaggctgggtgtggtggctcacgcctgtaatcccaacactttgggaggctaaggtaggtggatcatttgaggtcaggagttcaagaccagcctggccaacatgatgaaacaccatctctactaaaaatacaaaaattagccaggcatggtggcaggcgcctctaatcccaactactcgggaggctgaggaaggagaatcgcttgaacccaggagatggaggttgcagtgaaccgagatcgcaccattgcactccagcctgggtgacagagcaagactctgtctcaaaaaaaaaaaaaaaaaaaatcaggtgcggtggctcatgcctgtaatcccagcactttgggagtccgagaagggcagatcacgaggttaggagttcgagaccagcctggccaacatggtgaaaccccgtctctactagaaatacaaaaattaacctggtggtctggttgcggtggcccacagcggtaatcccagcagtttgggaggccgaggcgggcagatcatgaggtcaggagtttgagtccagcctgaccaacatggtgaaaccccatctctactaaaaatacaaaaattagccgggcatggttgcacgtgcctgtaatcccagctactcaggaggctgaggcaggagaatcacttgaagccaggaggcggaggttgcagtgagccgagatcgtaccactgcactccatcctgggcaacagagcaaaactcggtctcaaaaaaaaaaattagccaggcttggtggtgcaagcctgtagttccagctacttgggaggctgaggcaggagaattgcttgaacccgggaggtggaggttgcagtgagccaagatcgtgccactgtactccagcctgggagacagagcaagactccgtctcaaacaaacaaacaaacaaaaatacaaaaagtagccaggtgtggtggcaggtgcctgtagtcccagctacttgggaggctgaggcaggagaatcgcttgaacctgggaggcggaggttgcaataagcagagatcacaccactgcactctagcctgggcaacagagactctgtcccgccccgcgccccccccaccaccctgcgccaaaaaaaaaaaagtaaggtgagatcacagaggactgtggggtcgggtatcagaacactcagggctgggccctgcctctgacctcaccaatgatgaccttgggcacatccctggactttagtcacttctgtgattagggctttcagtgaacatgctgccgacagggtaggttttctatgaatgctttcttcctctgccagttctgatgttctttgagtctatccttggaggtaggatgaaatgggctaggtttgacctaatgttttctcatcctttagccacctcctcctagaggcccctttttccttagcatagttctgtatgccacaaaagatgcagaaaaaaattagacaccatcaatttccaaagagctatagtcttctgggaaaatgacaagcgatagggagaatgtgaaaatgtcagtggatgccaataatccctgtgtgacatttggccttatctaaaatatgctaagataaagagggatggaagagggtggtattttctgacttctgaggtcctttacaacactatcattctaagattctcctgtgagtatatatgtgtcgggggagtgggtctctgcatgtccagatgtacatgtatgttaacaaaaataaggaatgtgtccgatatatgcagacttgggacaattctttcccattctttttacttttaaatagatatataatagttttattgagatatgattcatgtaccatacaattcacccattgaaagtgtacagttagggccggatgtggtggctcatgcctgtaatcccagcactttgggaggccaaggcaggcagattgcttgagcgcaggtgttcgagaccagcctggacaaaatggcaagactctgtctctactaaaaatacaaaaaaaaaaaaaaaaaaaagccaggcgtggtggtgcacacctgtggtcccagctacttgggaggctaaggtgggaggattgcttatccctgggaggcagggcttgcagtaaacattctcctgcctcagcctcctgagtagctgggattacaggtgctcgccatcacgctcacctaattcccgccccccagcccaaggagtcttgctctgtcacccagactggagggcagtgatgcgatctcagctcactgaacctctgcctcccagtttcaggagattctcctgcctcagtctcccaagtagctgggattacaggcatgtggcaccatgcccagctaatttttgtatttttagtagagatggggtttcaccatgttggccaggctggtcttgaactcctgacctcatgatccgcccgccttggcctcccaaagtgctgggattacaggtgtgagccactgcgcctggccaatttttgtattttttatagagatgtggtctcactatgttgcccaggctagtttcaaactactgggctcaagtgatcctcctgcctcacctcccaaagtgctgggattacaggcatgagctaccgggtctggcgtattacccaattgttttatttactttctcttgattgctagtaaggttgagcctcttatggtttattgtctgtattcatgttgcctgtgaattacctgtttgtttcctttgttcctttttcttttaagttatttgtctttttcttcttgatttgtaggtctttattctagatagtaaaccttttgtcatttaaatatattataggtattttcaatatgttacttgtttttttaacttatctttcattgcatagaagtctttaatttttatgaggttaggtttatcactcttgtcctttattaaaacttttaggttttgtgtctttcataggaagcccttcctcattttaaaattagaaaatattctggccaggcgtggtggctcattcctataatcccagcctttggaaggctgaggcaggtggatcacctgaggtcaggagttcaagactggcctggccaacatgatgaaaccccgtctctactaaaaatacaaaaaattagccaggcatggtcgtgggcacctgtaatcccagctactcacaaggctgaggcaggagaattgcttaaacctaggaggtggaggttgcagtgagctgagattgcaccactgcactccagcctgggcaacaagagtgaaactctgtctcaaaaataataaaataaaataaaataaaataaaatattctgtattttctttaaatacttaagtttttttttagtttgtatagttctttaatacatctgaactttattttataagataacagtttgacgctatgtttttttctacatggaaattttcccaaggccatttactgaggccatcctttccccactaatttaaaatagggtgagaaccttttaatggattttggtaccaagtgagaaactgctttcttaaaaagaatgaactagtttatgcaaactgacatgggcaatgtgtatctgcccatttcactgcagccttgcgagtattagtatggttgttgtattgattgtaatttaagttaatttaaattacaacttaatttgtgtttatattgatacaaagttattttcatttctcagtgatataaataatggtatatggaatactttattgaatagaatcaatgccaaaacacctggtattatagaaagccttaaaaaatgactaggggcaggcgtggtggttcatgcctggaatcccaacattttgggaggtcagggtagcaggatggcttgagcccaggagtttgagtccagcccgggcaatacagtgataccctgtctctacaaaaaaatttttttaaattagccaggtaggtggcacacacttgtagccctgcctactcaggagactgaggtgggaggatcacttgagcctaggaggttgaggctcccgtgagctgggatcgtgccactgcactccaacctgcacgacaaagtgagaccccatctcaaaaaaataaagaaagaaagaaaatacaagaaaagggccgggcacggtggctcacgcctgtaatcccagcactttgggaggccaaggcgggcggatcacgaggtcaggagatcaagaccatcctggctaccacagtgaaaccccgtctctactaaaaatacaaaaaattagctgggcctggtggtgggcacctgtagtcccagctactcgggagactgaggcaggagaatggtgtgaacccgggaggcggagcttgcagtgagccgagattgcgccactgcactccagcctgggtgatagagcgagactccgcctcaaaaaaaaaaaaagaaaatacaagaaaagaagcgtgaagacagaggctcccgcgtcacctctcattttcttccattttctcttctgtgcctttcacaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggtaagagcctcagatgggtcgccagggttttgtagactgcctgctgactactgtatcttgaaggtccctggaaacaattctaccttgtagaaaaagcacaggttttataaccctgccttgggggctgtgtgacgtagaacaagtgtctaaacatctctgagtgtcagcatcctcatctgtaaaacagaaaacatgaccctatctcttaattccatcaaataaggattaaatgagaatgaccgtgaagtgcccagcacattgcctgggacatagagatttgataagtgacagctattgttgtttactattgtctttaaaacattctctctacttcaaaggagttcagaagctataataagaggcaaatgggctaattgctattagagagatgtgagcaaagtgttatgcaaacacagagaaaggagccattaaccctaacttgaacatttatggagagtgcatcacagagaaggtggcatttaccagagagcattgtgcacagtggtttataatgcacaaagtgctctcagggttcattaattcatttgatcttaaaatagccttttgaggtaggtgttattatcccattttacagatgaggaaacaggtttagagaaagggagtgaattgctgcaggccacacaactggttaagtggcagagccagggttgcaacccacaccttctgtcaagtcagaatgatccttgaagaatgaggaagatttggacagggactgcagtagaggaggttcaggagagggggaggtacactccaggcaaaggcaccagcatgcgcacaggcctagagattgaaaagtgttcagccaggtgtcacatctgtaatcccagcactttggaaggccgaagcaaggagaatgcctgaggccaggagttccagaccagcctggagaacatagcaagacctcgtttctttttcgcttttttttttttttttttttttgagacggagtctcactctgttacccaggctggggtgcagtggcacaatctcggctcactgcaagctccacctcacaggttcatgccattctcctgcctcaggctcccgagtagctgggactacaggcgcctgccaccatgcccggctaatttttgtatttttagtagagacagggtttcaccttgttagccaggatgatctcaatctcctgacctcgtgatccacccacctcagcctcccaaagtgctgggattacaggtgtgagccactgcgcctggcgaccccatttcttaaaaaaaacatttttttttttaattagcagggtgtggtggtacacacctatagtcccagctactcaggaggctgaggtgggaggatcctttgatcccaggagtttgaggctgcagtgagccatgattgtgccactgcactccagcctggttgccagagtgagaccctgtctcaagaaggaaaaaaaaagaaagtgttcagcctttgggagcactccatgttgagaggcttaggaaggagaaaaggcaagagagaccacagggatttgatggagaggctctgtgaatgcaggatagagggctatgacctgatgctgaaggccgtgggggccactgaggagttttaaggaggagagagatgtgcttccctggtgctgggtggagaatggctgagtggaggagggccatcagtcaggaggctgctgcacactccactctcacatttgaaaataccccatgaggcacggtggctcacgcctgtaatcccagcactttgggaggccaaggccggtggatcacttgaggtcaggaccagcctggccaacatggtgaaaccccatctctactaaaaatttaaaaattagctggatgttgtggcgggcgtctgtgatcccagctactcaggaggctgaggcaggagaatctctggaacctgggaggcagaggttgtagtgagctgagatcatgccactgcactccagcctgggcaacagagtgagactccgtctcaaataaagaaaaaaagaaaagaccccatgaggagcacaacctgggacttggaatcagagatctggtttccagatctagcactgcttgcactttttttttttttttttttgagatggagtcttgctctatcgcccaggcgggagtgcagtggcgcaatctcagcttactgcaagctccgcctcccaggttcacgccattctcctgcctcagcctcccaagtagctgggactacaggcgcccgccaccatgcccggctaagtttttgtatttttagtagagatggggtttcactgtgttagccaggatggtctcaatctcctgacctcgtgatccacccacctcggcctctcaaagtgctgggattacaggtgtgagccaccgcacccagccacttatacatctttaaactgtggatcataatgaagtttcctatctcatggagttatgatggggtttcaggttgataattgggcaagaaagtagtttttaaaccatcaagacaaatgttcgagcctgggcaacatggtgaaaccccatctctacaaaaaaacacacaaaaaattagctgggcgtggtggcacacacctgtggtcccagctactcaggaggctgaggtgggaagatcgctggagcccaggaggcggaggttgcagtgagccgagattgcactactgcactccagcctgagttacagagtgagaccctgcctcaaaaagaaaaaaaaaaaaaagggccaggcgcggtgtttcacgcctgtaatcccagcactttgggaggccgaggtgggcggatcatgaggtcaggagatcaagaccatcctggctaacacggtgaaaccccgtctctactaaaaatacaaaaaatgagccaggcgtggtggcgggcacctgtagtcccagctacttgggaggctgaggcaggagaatggcgtgaacccaggaggcggagcttgcagtgagctgagatcgcgccactgcactctagcctgggcgacagagcaagactccatctcaaaaaaaaaaaaaaaagacaaatgtcagcttatatgaaaataacattttcccttcagttgctccctagatgtggagagccctctccctcatggaggctccttctatagcccttggactggattaacatgtcctcctcctcctctccctgtacccctccctaggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgaggttctttgctccagtcctgcgggagcagggaatggggtgggggtgggggttgtaaccggggtagagcagatccttggacttttcctcaaagactgctgcttctgagtccccgagaacctcttcaaccacagctctcccttagggactgggaacaatttgacaccgtcagcattcaatatttttctaattactttaacttttttattataaaatagttaacacttatgtagaaaagtccaatagtataaaaggacagcttggcaaattattataaagtggatacttataaataccactgagtagaatattaccagctgtccagaaaccccccatggtcccttccttcctgacaatgccctctctctccctagaaattactgtcctgctttataatgtattgccatgtatgtattcctaaataatatagtttggttttacttatttttgaaactatgtagacagaatcatacacattcttttgtggctgacttctttcaagcaacattgtgattttaagactcataactagttcacatccaagcatttgggtaacaatggtgagttaagagggttcacatttgatgatttgtcctgaatatgaaccatgtttgtcttgcttttgtcctgaaattccaatacccagttttatgatggaaattttgtaaaattcaacttgaaccgctcagaagagtctaactgatgatactcatttactggggacatagtatgtgcccaagaacttgacatgcaccttctgtcttccatttagtcatcgttacctttagaaaaagctgattccgttaacaagatctttggagggaatcagcttcacaaacgtagcagtgggtgggggtcatgttggttaaccagttcacacatcagctcactaaaggaaaaaatatttctgcaaaaaatcttcacttgtcagaggggggtgcatgaaatttgagagccatgtgttatgcatccagctcttgaactggtctcagcttcagctggctgcagtgccctaggaagttactatgggaaaagtggaaatagttgaggcccagggaactgatcaggccagaggaagtggaagctcaagatcaactgtgcttattttgctgatggctgggcctaaatgccccaaccacctacttgggacaggaaatgacaggaccctctcaaccttggactgggaaaggagggcttcctggcccctgacagaccctggggtcctgaggctaccttagttgggattaaatgcccgtattggtctctagctgtcactccctctgctccttcctcaatttctgcacacatctcagagcttcctctagcagctcttcgacctgttttgttgttttattttctttctccccaggtgtgaatcaacttcttgggccttggctctgagttggaaaaggttttagaaaaagtgaagagctggaatgtgggggaaaataaaaagcttttttgcccagtgg

SEQ ID NO: 1313 - DNA, 11023 bp, Homo sapiens; identical to SEQ ID NO: 1312

SEQ ID NO: 1314 - DNA, 3901 bp, Homo sapiens
tctccactccattgttttattatgtacaaacgctacagaacgagggggacagacacgcgtggggtaagaagggcctggtgggaggagttcacagagcagacggtgcactgggaccaggagagcagaacacaggccataactatagggcaggtggggcaggaacgggttaaaaacgagatccaagccagccagatcgcaggaggtgcgggggcgtcgtcccccttctgttctccccccaaggtcacagtgcatgcaataaaatatatatacaggagctagatccgtcctctgcaggggctctgagggtccagagctcccttcgggtggcgggaagccagtggcgctccctggcggccaggccgggctggagccacatgcgtcgggggagcgggggtcagtcccagccgttgtctttgatcatgtggttgagttcaatgatgtacttcccctctttgtacttctggctgctctcaaaggcctgttcctgaaaggaggggcgggaccgtcatccccggagcaacagtctcaccacaaggcactggggttgggaagtggacatgagtggccccattttacatatgaggaaactgtggcccagaggggcagggccgtatttctcacaaacacagagtagaatagaactccctgactcaaaggtacttttttaagtactaatgatggctccaacagagaagatagggaagtggctaaaagatttcacagttcagggtttgcaaactggtagcttcatggccattttggcctacaacatgtattatgtttggacagcagacagtttaataaaaataactttaaagtattaaaatataagtaggccttgctcactccagtttgcccagcctgcccccaactcccaaccctgccaatctatgctaccctttacacatctacagtatctgcttggccttgcaggcacttgaggtttttttgtttgtttggttttgagagggagtcttgctctgtcgcccaggctggaagtgcaacggcgcgatatcggctcactgcaacctccgcttcccgggttcaagtgattctgctgccttggccccgagtagctgggattacaggcgcccaccaccacgccgagctaatttttgtatttttagtagagatggggtttcaccatgttagtcaggctgttctcgaactcctgacctcaggtgatccacctgcctcagactcccaaaagtgctgggattacaggcgtgagccaccacacccagcctggcacttgagtttttgacctcttgtttaggccagctctttattaattattattatttttgaaacggagtctcgctctgtctccgctcactgcaaggctctgcctcctgggttcacgcaattctcctgcctcaacctcatgagtagctgggactagaggcgcccgccaccacacccagctgattttttttttttttttttgtatttttggtagagatggggtttcaccgtgttagccaggatggtctcaatctcctgaccttgtgatccacccgcctcggcctcccaaagtgctgggattacaggtgtgagccactgtgcctggccggccagctctttatttggtagaggtccagagtggccaagccacctgtccagagacacacagccaatctgtggcagggtcagcagcgagctcaggtcagggctggctggctggctctgcctgggacatccacctcacagaggcaccacagttccaagcgacgcctgaagaatcctgtcccttgcagtgtcccaagagcatcttcctgagcatctaatctgatccctgtaacaatcctgggtgctaggcagtggctttatcttccactgagagataaggaaatgagactcagggtagtgaaatcagaccctggacagcagcagtggcaatgaggactatggaaagggaggctggtgaacccaagctccatgttgttgcagagtctggggcaatttttctgatactctaaatgacaatataagctggtgaccaagggtttggagtgaaaaaaaaaaaccaaccaaccaactcagattctggtccctattctgttacttaccagttgggtgatcttgggcaagttacctaacatctctgggcctccctgtcttcttctgtagagataataatagcttctacctagaggatcactgcaatgattgaatgagataatagacgccaggcacacaacagtgcaaggcacataaacattccataaatggtgactctgattatatcctaactctctaatggggatccaagtgcctgggagagaagggatgggttaagagaaaagttctacaccccttgcaaggtgcaagataaagagaatgtggtcagggatgctgacttgtgtgagctcggcctatgcaatctgaaaggctatagggtgacagcttgtcaggaggaggtgttggaaggtcaggtcaaaggctagcctggggtcagaggtgggtgactcacatatttccagcccaaagtggtcttgcagttctcgcagtggatgtcggcgacagcatggaggccggtcagcagcacccgctcctcggctggcccgcagcccacgttcaccctgtggggacatggggtagtcccagggagggtcctgccatcacagggcccaccccctcaagcactgtgtctgtcctcagcatccaagaaatgatgctcacaatttcctgcctgcaccggggaactctgggagtctcagcaggatgccaggggtcacaggtcacaacagaggtcagggaaagcaagaagggaggccagatactcacactgagttgaagaggtaggcacgcccctgactgccctggaaggactaaagggtgagagggtgggaagagaggagggggtcagggctgccggtggggagctgccaggcagcccctataggttccagccccactgtggcctggttggttaccttggagatgaggtcgtcgtggttggccaggtgagcgcggcagtgggcacagctatacctccggtgacaatcatccaagtaggcctgaaacgtcttgggctttgaaatccgcaccatggcgggggccgggggcagtggccccacgcggggagcggcccacggggagcagagggagcccagtgcctgccggggagggagtaggtgggctgtcaggacctgggccacacacatgcgaggcactcccagagccgtggggactcgctctgtcacactgggctgctctctcctttccccagagccagcagcctctccggggaccagaggcgtctcggttttgactcagtgaggaggcctcaggttgcatccatggggaaactgaggctcggaggtgcccagggtgagtcacccgcctgcttccggcctcacccttgctgacctggcagctgaagctggaggaaggggctttggaggggctgggctgtcagttcccagtttcgggggagcatgggcgggtaggcactggttggtccttgcgacctcatctggagagcagtggggttcactggtggtttagggggttcatcggggagagggtcccccacctggaggaggtaggaggcctcgccgtgaaggttgagggtcacctaggaggggaggggctctcacctgcgggcgccaaggcctcctctacgctcaggggctcttacctgcaacgcggagccttacctggactccggggctcacctggggcgcgggggtgggggcgggcgccgggggagggggcagtcctcgcgggctgggcaggggcgcggggcgacacgcagccctgacggcgcgggcctcacctcgcctgggcgcgcggggcccggtccgccggggtgggctggcctgggagtggggggcgctcctggcgggcgccgtcccccccgggcccgggttcgcaggcgcctggacttgtttacacc

SEQ ID NO: 1315 - DNA, 3887 bp, Homo sapiens
tgtctccactccattgttttattatgtacaaacgctacagaacgagggggacagacacgcgtggggtaagaagggcctggtgggaggagttcacagagcagacggtgcactgggaccaggagagcagaacacaggccataactatagggcaggtggggcaggaacgggttaaaaacgagatccaagccagccagatcgcaggaggtgcgggggcgtcgtcccccttctgttctccccccaaggtcacagtgcatgcaataaaatatatatacaggagctagatccgtcctctgcaggggctctgagggtccagagctcccttcgggtggcgggaagccagtggcgctccctggcggccaggccgggctggagccacatgcgtcgggggagcgggggtcagtcccagccgttgtctttgatcatgtggttgagttcaatgatgtacttcccctctttgtacttctggctgctctcaaaggcctgttcctgaaaggaggggcgggaccgtcatccccggagcaacagtctcaccacaaggcactggggttgggaagtggacatgagtggccccattttacatatgaggaaactgtggcccagaggggcagggccgtatttctcacaaacacagagtagaatagaactccctgactcaaaggtacttttttaagtactaatgatggctccaacagagaagatagggaagtggctaaaagatttcacagttcagggtttgcaaactggtagcttcatggccattttggcctacaacatgtattatgtttggacagcagacagtttaataaaaataactttaaagtattaaaatataagtaggccttgctcactccagtttgcccagcctgcccccaactcccaaccctgccaatctatgctaccctttacacatctacagtatctgcttggccttgcaggcacttgaggtttttttgtttgtttggttttgagagggagtcttgctctgtcgcccaggctggaagtgcaacggcgcgatatcggctcactgcaacctccgcttcccgggttcaagtgattctgctgccttggccccgagtagctgggattacaggcgcccaccaccacgccgagctaatttttgtatttttagtagagatggggtttcaccatgttagtcaggctgttctcgaactcctgacctcaggtgatccacctgcctcagactcccaaaagtgctgggattacaggcgtgagccaccacacccagcctggcacttgagtttttgacctcttgtttaggccagctctttattaattattattatttttgaaacggagtctcgctctgtctccgctcactgcaaggctctgcctcctgggttcacgcaattctcctgcctcaacctcatgagtagctgggactagaggcgcccgccaccacacccagctgattttttttttttttttttgtatttttggtagagatggggtttcaccgtgttagccaggatggtctcaatctcctgaccttgtgatccacccgcctcggcctcccaaagtgctgggattacaggtgtgagccactgtgcctggccggccagctctttatttggtagaggtccagagtggccaagccacctgtccagagacacacagccaatctgtggcagggtcagcagcgagctcaggtcagggctggctggctggctctgcctgggacatccacctcacagaggcaccacagttccaagcgacgcctgaagaatcctgtcccttgcagtgtcccaagagcatcttcctgagcatctaatctgatccctgtaacaatcctgggtgctaggcagtggctttatcttccactgagagataaggaaatgagactcagggtagtgaaatcagaccctggacagcagcagtggcaatgaggactatggaaagggaggctggtgaacccaagctccatgttgttgcagagtctggggcaatttttctgatactctaaatgacaatataagctggtgaccaagggtttggagtgaaaaaaaaaaaccaaccaaccaactcagattctggtccctattctgttacttaccagttgggtgatcttgggcaagttacctaacatctctgggcctccctgtcttcttctgtagagataataatagcttctacctagaggatcactgcaatgattgaatgagataatagacgccaggcacacaacagtgcaaggcacataaacattccataaatggtgactctgattatatcctaactctctaatggggatccaagtgcctgggagagaagggatgggttaagagaaaagttctacaccccttgcaaggtgcaagataaagagaatgtggtcagggatgctgacttgtgtgagctcggcctatgcaatctgaaaggctatagggtgacagcttgtcaggaggaggtgttggaaggtcaggtcaaaggctagcctggggtcagaggtgggtgactcacatatttccagcccaaagtggtcttgcagttctcgcagtggatgtcggcgacagcatggaggccggtcagcagcacccgctcctcggctggcccgcagcccacgttcaccctgtggggacatggggtagtcccagggagggtcctgccatcacagggcccaccccctcaagcactgtgtctgtcctcagcatccaagaaatgatgctcacaatttcctgcctgcaccggggaactctgggagtctcagcaggatgccaggggtcacaggtcacaacagaggtcagggaaagcaagaagggaggccagatactcacactgagttgaagaggtaggcacgcccctgactgccctggaaggactaaagggtgagagggtgggaagagaggagggggtcagggctgccggtggggagctgccaggcagcccctataggttccagccccactgtggcctggttggttaccttggagatgaggtcgtcgtggttggccaggtgagcgcggcagtgggcacagctatacctccggtgacaatcatccaagtaggcctgaaacgtcttgggctttgaaatccgcaccatggcgggggccgggggcagtggccccacgcggggagcggcccacggggagcagagggagcccagtgcctgccggggagggagtaggtgggctgtcaggacctgggccacacacatgcgaggcactcccagagccgtggggactcgctctgtcacactgggctgctctctcctttccccagagccagcagcctctccggggaccagaggcgtctcggttttgactcagtgaggaggcctcaggttgcatccatggggaaactgaggctcggaggtgcccagggtgagtcacccgcctgcttccggcctcacccttgctgacctggcagctgaagctggaggaaggggctttggaggggctgggctgtcagttcccagtttcgggggagcatgggcgggtaggcactggttggtccttgcgacctcatctggagagcagtggggttcactggtggtttagggggttcatcggggagagggtcccccacctggaggaggtaggaggcctcgccgtgaaggttgagggtcacctaggaggggaggggctctcacctgcgggcgccaaggcctcctctacgctcaggggctcttacctgcaacgcggagccttacctggactccggggctcacctggggcgcgggggtgggggcgggcgccgggggagggggcagtcctcgcgggctgggcaggggcgcggggcgacacgcagccctgacggcgcgggcctcacctcgcctgggcgcgcggggcccggtccgccggggtgggctggcctgggagtggggggcgctcctggcgggcgccgtcccccccgggcccgggttcgcaggcgcc

SEQ ID NO: 1316 - DNA, 3409 bp, Homo sapiens
agggcttggacctggtataaaacatctggaagtttccagggggctgctttgcatctgaaactgtcaggtgaggggtgacagagatgcctgaatctgagttgggggggaattcaaatctgagctggcgaagaggatgcctggaaggaatggcaggaaagacttgagttaattggcgcttctgggtctgcagtaatcttaggtgcaaagctgtctaggtctctgctgaaggactggggacacctgggatgttcaggagaatagaaatggccagatgtgtgttagtggagaaaagaatagtgacacatagaccaggcacctggggtctaatatcttgagctggtcccgactccttctgcaacttctctgtctgtcctagttccaccagcactgcttggatactggtgctggcacagttccttctgtcaccaactttgctccccaggtaacatagaggcaactctaaaatgcttctttccttgagaccaggtggatgccagggatttaaaccatgctccaggtgccccataatccaggccaattcaccacagatgatgaggctttctttgctcagcctctgggctcagtaaactcagccatctctttgcttgggagaggtcctctactccctccttagaaaactcgtttcctggctatggccataccaacccaaatgtacctgggcttggctgacttcagaaaacttttctgctttgtgccaggatggaataaggcttaatccagatagttagagttcatcttcaggcctgagagaaaaagaggagggcttggctacagccagaccagggagagctggaggggtcagggacattgaaggtagcatcagagaggaacaggactacaggctatggacagtcctttctaagctcaagactgggtctgctaggtctaagttgaaggacgaagaaggcttggtctgagctgcaggtcaggagtgcctgggtcaatcaagtcaacaaggaagaaggtgaatcttcatttgctcttttcttcccactccagccccagaatgttgacagtcgctctcctagcccttctctgtgcctcagcctctggcaatgccagtaagtgagataccaggagcctggtattggggacttgggaaggcagccttgggcactgctgttggccaaggcttttggaggttggcttggggtggggagctgagttgtcggaggaacaggggtgatgcagagaaactgaactcctggaagatttctccctccaactcctgcttgcccctccagttcaggccaggtcttcctcctatagtggagagtatggaggtggtggtggaaagcgattctctcattctggcaaccagttggacggccccatcaccgccctccgggtccgagtcaacacatactacatcgtagggtaagattctttgaattcctggctgggcgcggtggctcacatctgtcattacaatgctttgggaggcagaggcagatcgcttgaggccaggagttctagctcagcctgggcaagatgccagggatgccagggatttaaaccatgctccaggtaccaagaccccatctctaccgaagaaaaacaaaaaaattagccaggcatggtggtgagtacctgtagcctcaactactcaggagggagaggcgggaggattgcctgagcccaggatgttgaggctgcagtgagccaagatcatgccactgcactccagcctgggtgacagagtctctttgttggcaaaatgagttgaagttccctgtaggatcttccagggttcacccaggcttcacagtctgtaggactagccagagacctctcatccctatcatcacctttctttctccttccttcctcccctcttcctcagtcttcaggtgcgctatggcaaggtgtggagcgactatgtgggtggtcgcaacggagacctggaggagatctttctgcaccctggggaatcagtgatccaggtttctgggaagtacaagtggtacctgaagaagctgttatttgtgacagacaagggccgctatctgtcttttgggaaagacagtggcacaagtttcaatgccgtccccttgcaccccaacaccgtgctccgcttcatcagtggccggtctggttctctcatcgatgccattggcctgcactgggatgtttaccccagtagctgcagcagatgctgagcctcctctccttggcaggggcactgtgatgaggagtaagaactcccttatcactaacccccatccaaatggctcaataaaaaaaatatggttaaggctagtctgtgtgggggcatctgtggctgggatatctgcctcctgacttagccggggacgtgcaaatctcacttctggctggctttggacatctgtctggaagatgggaagatgagggagaggtatgtaagaatcctgggctttgtgctataatttatcaagaggagatgagattctggcttgcatcaacgctcttcaaggacagctccttggaacattgatccaaactggagtcatgggtctgagggcaaggcctagttgtggcttacaccaaaaccccagatgtcccactctccagctctcctcacccctggtcctccccttgagaaagtggtgaactcacttgctgtgtgtgggtggccaggaccattagcctttgttctttcccagaacccacctgactcctgaaacttagctgaagtctgtgcccgaggaccctgccctgttaccaggcccagttcctcctcacctctacccatgagccccggtgtcctgctaagccctctcagatctgggattcctccttcctcaggaagccaccaccttctcagcagtggaaaccctgcccacactatgctcttaggctttagccatcagaaggttacagtggactgcgggaggctgacactaggctgaactcattaaggaatgaatgggaggtgagaagacacaggcagcaagaatcgagtgtttcaagaagtttggctgtggtttgccagaaataggcaagtcagttttcgggggtgtaaggaaaaagggttttgtgtctttttaaaatcctagacaggagagtcacaagcatgttcacatgataaagaggaagaaagagaaagaggctggagattctgaaaagagatcactggtgaggtctcaaaagagatagaagaggatggttatgtagttggggaaagaaattttaagaagggaagaaaattaaaatgagtgaaggtatacgttagttttgtaaaagttatcaatatctggctgggcacagtgctcacacctgtaatcccagcactttgggaggccaaggcaggcagatcatttgaggtcaggagttggagacaagcctccaacatggtaaaaccctgtctctactaaaaatacaaaaattagccaggtgtggtggcagt

SEQ ID NO: 1317 - DNA, 53909 bp, Homo sapiens
ccaatttaaaatggtagaatttattttaatataatgatatatatgtgtccacatatactattttaaaaataagcatgtaaattataatcattataaaacataagttagtcctaatttaatattatcagagtaaaagagcacatatagaagtcagtctaactttgttgcacttgtcttttaaagttagaatacataaaagatttagcacgttgtattttatcttatttcagttttcatgttatcatcaactataaatacccttaggaatgtaccaccttataacttacattgaaatagccaatatttcttagtagttattaaagtaccattaaatcacctaaaacaaataatctaaaaaaatactagtttaaattaaaaccctgaggaattaaaatttgttttacacaatagttttggttaagtgcaatttcatgtacatactactttgtttaaggatgtacttggtaaggcatagtaaaaataaaatctacgtaagtaacaatctaatactatatttaatttgttgctacaaagttgttttgtttctctaaaaagtagtttttgcatatcattctggacctcttcacccatctgctggcttatttgctttatatacaacagttaaaatttgtgcactaagctgagctgccttcacaattgtggttcagacaaaatgcacccaaagaactacatgttaagagagttcatgtccatgctcaaccatggcttgcacaaattgcttgaagacacgatccatgtaagtggactgtcttggccagattccctccagaaaaccaatatggcctccataagaagtaaggaccaaagcaacattaggattttgcttagcagtttctattggaatagcttcagaccaaaaaaaacatggcaataagagagaagaaggagagagaaaaatataatcattatgtttttgtcaggaaaagcatatacctttatcatgtctaataaacagaaatcaaaacaccattatataaatatatgtaatgagcatagttaaatggaatgagtctaccttatatcaactatattcttacaacagttcatatatatggtcatgtctgcacaatcattttgggaagaatcaatccaagattgttcttcataacacaaaagtatacatcaagtcttactttgagaaattaaagtaagacaattcaaggaatggtgaatcctcataataggctataaaattcccactgaagtgttagggcaggggaaaaaactaagcttagcatctttgtgagagttagaaattcattaggtattattttgattaactttacatgatgtggctgggcatggtggctcatgcttgtaatcctagcactttgggaggccgaagtgagaggatcacttgagctcaggagttcgacaccagcctgggcaacatagtgagaccccatcttgaaagaaagaaaagaaaggacaggaagaagaaagaaaggaagacaagaagaaagcaaagaaaaataaagaacgaaagaaagagaaagacaaaaagaagaaaaagaaaaagagaaagaacgagaatgaaaacaaaggaaagagagaaagaaaaaagaaagaaagagagaggccaggtgtggtggctcatgcctgtaatcccagcactttgggaagttgaggcaggtggatcacgaggtcaagagatcgagaccatcctggccaacatggtgaaaccacgtctctactaaaaatacaaaaattggatgggcgtggtggcacgtgcctgtagtcccagctacttgggaggctgaggcaggagaatcgcttgaacccgggaggcggagattgcagtgagccgagatcacacctttgtactctagcctggcaacagaacaagactccaactaaaaaaaagaaagagctcacgcctgtcatcccagcactttgggaggctgaggcaggtggatgaccaggttaggagatcaagaccatcctggccaacgtggtgaaaccccatctctactaaaaatacaaaaattggctgggcgtggtggcgcacacctgtaatcccagctcctggggaggctgaggcaggagcattgcttgaacccgggaggcagaggctgcagtgagccaagatcatgccactgcactccagcctgggcgacagagcaagactccatctcaaaaaaaaaaaaaaaaaaaaaaaaaaaagagctgggtgtggtggctcacgcctgtaatcccagtgctttgggaggcagaggcaggtggatcatgatgtcaggagttcaagaacggcctggccaacatggtgaaaccccatctctactaaaaatacaaaaaatagccaggcatggtggtgcacgcctgtaatcccagctacttgggaggccaaggctgcagtgaactatcgcaccactgcactccagcctggtgacagagctaatttttgtatttttagtagagacggggtttcacaatgttggccaggctggtctagaactcctgacctcaagtgatttgcctgcctcagcctcccaaagcactgggattacaggcgtatgctacctgtctggcctgagtataacctttaaaagatatgaattaaagttttttttttctcccatgcttagaggtcagtgaaaatgttttgatataaggtctctaatggatcaaaacctggcatgagaagtgttttgatttcagatactgccaaatcttatctccctaattaagataacatggttgaggccagtgtggtagctcatgcttgtaatctcagcactttggggggatctcttgaggctaggagtttgagactagcctgggcagcatagcgagactgaccgtgtctttacaaaaaatgttaaaaaaaaaaaaaaaaaagccttgtgtggtggcatgcacttgtagtcctagctgaggctgaggtgggaggacagcttgagcccaggagtttaaggctgcagtaaactttttttttttttttgagatggaatttcactgttgttgcccaggctggagtgcaatggtgtgatctcggctggcttactgcaacctctgtctccggggttcaagcaattctcctgcctcagcctcctgagtagctgggatcacaggtgtgtcccaccacggccagctaattttgtattttttttttttagtagagatggggtttcaccatgttggtcaggctggtcttgaactcctgacttcaggtgatccacccacctcggcctcccaaactgctgggattacaggcgtgagccacttcgctcggcctgactgcagtaaactatggtagtatcagtggactccagtctgggcaacagagcaagatcctgtctccaaatatatatatataatgtgattgatgcaataattacaacttcacaacttgggctgagttttaggggcaaatgagctaattaaaggtaacagcttctctacctcacccccttgtaagaaaaaggaagctaaaattcactgtaagagaactggggcccttccacaaattgactgtttagacagtgctctaaatttgacccttcataacactctaaagaataaaccgatagccctaaagcaaggctcaacaagctaagttcttatcaaaaagtggtcctgagttcacgtccttagctagccacgtccgtcccaagaaagaacacctaaaagtgaacatctatcttgggatcaggtgtgggaacttaagggggaatggctgatactatttttgcttttcctttttcaccaaacatttagagtgtttcatttgcctctaaaggaattatcaagagcctaaacttcacactctggatacattcagaaatttctaacagagagttacagtcatatcagaagaacaaaaggctgggccacatttgaggcatgtgaaagatgctggctgcctgttctctcagactgcagacaattgtccactatttcattgcggcaagactattttaaaggcttgggaaagaataggaaataatgagttcaaacttcacccaagtgggtaaggttaaaatgttgggaactttttattggtaaaaagggcagtgaaatataaaaacgggtagagaaatactggacttccttaatccaatgaaaatatgctaaaacaatcaccatgtaagtcaactgatattaaagttcagagtttcattttctaaattgtggtcaaggctgtaagtttcagcttctaagattacctgtgattaaacataaatcacacaataaaataggatctcctagagaaatgataggtaatttaaaaatatatatatatacacacactggggattttctgaaaatttcacaacatatgtgttatgtttatagtcagaatcattttttaaatgaagtatttggggaaaatggttttaatgcattgaggggaaagagagaaaaagtttttttttttttttttttccaagatagagtctcactctgtcacccaggctggagtgcagtggcacgatctcagctcactgcaacctccgcctcctggttcaagcaattctcctgcctcagcctcccaagtagctgggattacaggcacatgccaccatgcccagctaatttttgtatttttaatagaggtggaatttcattgcgtgggccaggctgctccttatctttgttatcaaatttcatatttcttgacttaagaaagcaggaaagttggcggggtgtggtggctcatgcctataatgccagcagtctgggaggctgaggcaggcggatcgcctgaggtcaggagttcaagagcagcctggccaacatggtgaaaccctatctctactaaaaatacaaaaattagccaggcatggtggcgggcacctgtaatcccagctacttgggaagctgaggcaggagaattgcttgaactcgggaggcgtgagccgagatcgtgtctttgcactccagcctgggtggcagagtgagactccatctcaaaaaacaaaaaaacaaacaaaaaaaaggaaagcagtaaagtttaggctgggtgtggtggctcacgcctgtaatcccaacactttgggggaaccaggcaggcgaattacctgaggtcaggagtttgagaccagcctggccaatatggtgaaaccccatctctacaaaaatacaaaaattagccaggcatgatggcgggtgcctgtaatcccagctacttgggaggctgaggagggagaattgcttgaacccgggaggcggaggttgcagtgagccgagatcgtgcctttgcactccagcctgggcgacagagcgaaaaagaaagcaggaaagtttatttctgaataattttctttttttttaagagacagggtctcactctgctattcaggctggagtgtagtggcatgatcatagctcattgcagcctcaaacttctgggctcaagtgattctcccacctcagcctcccaagtatctgggactacaggcacacaccaccatgcccagctaattaattttcttttatacagtattccagggaaaaggaaaggatgtttctctttaaatatgaccttctagtccaaatatgcttcactaattgagatattcaaagccactgtgtttataaagtctcaagttctcttccagattaaaagggaagaaaaacttcaaattcttctttataggaatctcaggaagaagaggcaagtgataacaatattctcctgaggcaaaaggactgtaacataatctgtccaaagaacagtgtatttggtaagaaggaaaggttataaaaatgagaatgagcaaaacagtgagtcataatttgttctgagcctctcacaatggactagataagggtctgtgaaaatatttaagtgatttgagacatttagatactgtgttatgagtatctagtttttttatcataatggaaatgacacattttcttattactatatttccttaaaaataacaatatattaaaagttgattcatgtcaaaatatatacaaatatgttaattttaccatgactgggtgagaaaacatcatccacagaatttagacacaatactggaattcctactgacttcagtctaggactcggactggcatcagtataataatcatcaattgtttggtatccaaacatgactgaagtgaatcgcttatcaaactctctgatggatttagcctgaaacacaaaaacaaattatatctagtcttgcccaaaagaagaaataaaagtattacataaagtttctctcctaccttcatgacatgatccatatcaacttgttttacaaacatatgtcggtgcctggaacaaaagaatttcggaagtaaaaatcaagatcattcctactccatcatactaaaaggacttaaaaacaaattactaaacagcctaccacagggcacaaagttggcactcaataaatatttgcttaatcaggtacggcaggattagaataataatgtttgtgctgaagatattttcttcaagtacttttttttttttttttgagacagagtcttgctttgtcgcccaggctggagtgtagtggcatgatcacggctcactgcaccttcagcctgctgggctttagtgattctcccacttcagccccagagtagctgggactacaggtgtgcaccaccacaccccaccaattttgtgggttttttttttcttttggtagagatggggttttgccatgtcacccaggctggtctcaaactcctgggctcaagtgatccaccctcctcggcctcccaaagtgctgggattataagcatgagccaccttgcctggcctggtaaaatctaatccagtgtttaatgtcaacttccaggataactaaggttttcagtaagtcatgtgcaaatcaacagtacttttaaagtttatattcatcaattcacttaaaagtacgtaacagtcataaaaaaataaagattatagcattgcgtgcctgtatcaaaatatctcatgtacctcataaatatatacacctactatgtacccacagaaattaaaaataaaaaaaattaaagaaagaaataagcaaacagaaatatctctgctgggcggggggctcacgtctgtagtcctagcactttgggaggctgaggtggatggattgcttgagttcaggagttagagaccagcctgggcaacatggcaaaacctcatctctgcaaaacataaaatattagccaggtgtggtggtatgtgcctgtagtcccagctacttgagaggctgagatgggaggatcacttgagcctaggaggctgaggctgcagtgagccatgatcacaccactgcactcaagcctgggcaatagagagagacccagtcttaaaaaaaaagagggagagaaagaaaaagaaaaaaagaaaatacacaaacaattccagagaaaactaatgcaaagatagtattttggtagtataagagctgtgagggctgagattatctaagtgaactgcattctcctgtctctaaaacatactatgctcataagcacaccctcaaggagctgtattattcagcaatgaaagtacttactacattactatccaggaaagacttaggtattactaagattagcaacaagtagaaaatccagggaaacagcccatcacaccacttaacacattccatactaacatttttagtcttttagaataatttagaatggtgattagaatagtaaccttcaatagtgtaccttcactaaaaatggggcacatacttcaggggttgtacaagacaatccactggggttcagaaggaaaacattacaacttttagctatatttttaacttatgcttaaattttaacttatacttacattttttatttatatgcatttacaacaaagataatattttggtacagtagtaaatttattcagtgtataaacacatatacatatattggtagtattacgctttaaatttttttactgttggggcatgtaatcatttggagacaatagttttttttttttttttttgagacggagtcttgctctgtcacccgggctggagtgcagtggcacgatctcggcttactgcaacctccgcctcctgggttcaagcaattctcctgcctcagcctcctaagtagctgggactacaggcacacatcaccacggccagctaatttttttgtatttttggtagagacggggtttcaccatgttggccaggatggtctcgatctcctgacctcgtgatccccccgcctcagcctcccaaagtgctgggattacaggcgtgagccaccgggcccggccctggagacaacagattttaaagatgactcacttattaactgaagactgaaggcaggttgtcaaatagtaattaaaaagtagccagttcagtggtttttccaatgactctgagcaagcgaaggtgttccaaccaacggaaaaagttgcagctgccatcaaaggcgttttggacccaattttgcccaagtaatttagaagcagcattctaaaatggggagaaacaggaaactcagtgattaatttgttgtatcacagaagacatccatttctaactacagactttatgttaactatggagaagaaaaatataaactagtgtttaagtcctctatcctggaaaagcatgcaagcatcttcattctttccttatattcatatatttatttgtcttgcagtcaactatgtggtaaatgggacaaatcatagttattccttatatatgtatcctatgaagtcaaacataagagaaatccaccctaagagtggtttttagatgtgactgcatgctggaatcacctagagttttttttttttgtgtgtgtgtgtttgagacagagtcttgctctgtcacccagcctggagtgcagtggtgcgatctcggctcactgcaacctccacccccctggttcaagcgattatcctgcctcagcctcccgcgtagctgggattacaggcatgcatcaccacgccccggtaattttttgtatttttagtggagacggggtttcattgtgttgaccaggctggttttgaattcctgacctcaagtgacctgcccaccttggcctcccaaagtgctgagattacagccgttgcacccggcctttttttttttttttttttttttgagataggctctgtagcccaggttggagtgcagtgacacaatcacaccttagggcagccttgatctcctgggctgaagtgatcctcccaccttaccctccccagtatctgggactacacgtgtccgccatcaaacacagctaattaaaaaaaaaaaaaaaaattttttttttttttttgtagagatgaggtctcactatgttgctcaggctggtctctagctcctgaggagtttgtaaatgactactgatgtctaggtcttaccctgagagattgtgagttaactggtctggatcactaccctagctgccaaggatccttgcaccctgtggcaagtttctaaattgctctctagtctagactttctgagttgtggtagaacagctgacccctaaagtaacttgttttctctttctattcctgttatttgtccttatttcctaacacatattttcttctgttctttttgttctactaattttcttgattctatgctaattctattttggtaagagagaccataatcatgtctaatctacatacacaatgttgaaaatctaaagtttaatgctgcctagtaacaggatgatatcctaattgtttctcattatattttttgtacttgatttcttcaattgtccatgttttgaaataggagaaatggcttaaaattccccctcattcttttttccagttcaaatgacttgctggggtgaatatgatgaagttttagatggaaagtggacatttagcttttgaaaatgatccttcataacaactgaactatctgtatacagtattgtgattcaccaaaccatatataggacaatgcttactcttctgcaaagggttcattctagagtcctagttttggtggccctactctttgatgggaggtcagatattgttgggaggctggtaaaatgcacaaattagaaggccttgaagggaaactcaggactaggaagattcagaagtagatatgaccaagcaggtggaatacgtcttggttattactcagcagcaaaatgatgctaagatgttatccccaaaaagactgttttacttctataggaaaaggaccctattttctcaccaaaagaaaaaaactacaagctaaaaaaaaaaaaaaaaaaaaaaaagagaaataacccctggattaagagacttaaaaagcataccaatctcaatgtatagacttttcctggcttctaactaaactaaaaccaaacaagcaaacaagactatttgggaaatgtgaacacttactgaatactgtatgatagtttgaaattagtgttaattttattcaggtgtaataacagtaatatggttttgtttttttgttgcttgttttttaagataaactccagccgggcgcagtggctcatgcctgtaatcccagcactttgggaggctgaggcaggcagatcatgaggtcaggagtttgagccaggccaacatagcaaaaccccctctctactaaaaatacaaatattagctggacatggtggtgggcgcccgtaatcctagctactcgtgaggctgaagcaggagaatcacttgaacccaggaggcaaaggttgcagtgagctgagatcgcaccactgcactccagtccaggtgacaatgggagactccatctcaaaagaaaacaaacaaacaaaaaaacccacaaaacataaactccactgtttttttttttgagatggagttttgctcttgttgcccaggctggagtgcaatagcacaacgtaggctcaccgcaacctctgcctcctgggttcaagaagttctcctgcctcagcctcctgagtagctgggattacaggcatgcaccaccatgcccagctaattttgcatttttagtagagacggggtttctccacattggtcaggctggtctcgaactcccgaactcaggtgatctgcctgccttggcctcccaaagtgctgggattataggtgtgagccaccgcgcctggcctttttttgtgtgtgtgagacggagtctcgctctattgcccaggctggagtgcactggtgcgatctcagctcatggcaacctccaccttctgggttcaagtgattctcctgcctcagcctcttgagtagctgagattacaggcatgcgtcaccatgtccagctaatttttgtatttttagtagagatgggggtttcaccatgttggccaggctggtcttgaactcctgacttcagatgatctgcccgccttggcctcccagcgtgttgggattacaagcatgcaccatcatgcccggctaatttctgcatttttaatagagatggggggtttcaccatgttagccaggctggtctcggactcctgacctcaggttgtctgcctgcctcagcctctcaaagtgctgggattacaggcgtaagtcaccacacctggcccaccttttagagataccaactatttataagtgatgtctgagatttggtacacaataatcagagttgggagagagaggggagggggtgacactgatgaaacgagatgatccatgagttgctggcacttggccccaggggcatcataggctctatcacagggattaccccagtccatggggcactgggcataaggatcgtccatggactgtttttgcgtgttgcatctccataagaaaaaatgtgtcaagatataaaacacatccccaagtggtaagcccacttgggatcgtgtcacagtgctaggcaactagaaggggtgcttccgtctaacagttcacaagacattaatgttcaaccagctgtaaaggctaatggtcaagttctgccttcaggcactgaggcttcaatgcggcacgaatagacatttcccaggagcattgaatagagaatctgaacctgtgtatgtaagctccggcctttagaaaagccatgcgtttatatgattaagggaaaagttcagctctcacccagtcctttaaggttcacattatgggggaaaggaaagtgacgctaaactccgtccattaagcacaattcagagagtctgcgtgggttttctccattgattgagatttcttcctttagtaggtcaagtcagaccttccatgctaatggaagaaatgtattcttttcttcttagttttatgtttatcagaatctaaaaagctgtggttaaaggcctgttttttagagtctatcatttgtaaatgctgttcattatctttttaaaaaaattaaaattttttttctttttcacagccactggctatagaaaaatgctattcattttcaagtgattcatgttcaagatgttctaaaaactgaaatgacagataaaccaattataaaattatgaaaaaatatcattttctatcttcagtatttgctgatttaaaaaactagttttggacaatggcttcaggaatctaaaagcttagtaaaattcccgataataaaaattttggatttccttaagctcaccatcactagaacaaccaaaaaaaaaaaccccaaaaacaattagtagaaataagcctaaataggaaagttccaaataagccccaaagtaattgcaagcagcacaaatgacaatatccgtatgcttaaaataacagctggagtagggggttaacaaaatttcagtttctaggagagcactccacagtagttccatttgcccagcaacaaaacaaaacaaaacaaaataccacctggggaaaaataattttgaaggccactgcagctggagagagcaataagtgattatttctgtaactggagtgatgaaagtcatgctacaagttcagcttcagaacgcagctccagggatggctgggagtgcgtcaggaatcagaaggtcaacatggcagccggtgagtgatgcaatcgacttcatgggcttcagacaaaccttcaggctcacaaaatccgcagtcacagagacccgtagttaagaaaaatattaaaattcacctgaattaattctttccttccttcgttcattcaatcaaccgcatttaataaaatatgataaacataatcagacatttatttaaaaagtgtccatacagctagcttatagtcctctcaaagagacagccaataaaatagcttccctctcagagattattttagaaagggaaaaccttaccctcccattgaaacccctgctgccaggaaaggagcagaagggtacaggctgtgtacatggtgaataactgtctccaagtcttcagtgttagcacaacaataagtccttggcgtctggaagtagtgacaagtaaagcacaaaaattacaatgtgaggttaatgatttgtaaaatgcagaaatgtaaacaggagcaaggagtcatacatatgagaaaataacctttgtttgcacatactgtagtattaataatttatcattttcctgtcttgcagcgcacatacatgccatttaaagtcagcacagttagagttggcactaacaaaaagaccatgaacatgcaaggaaggcttgatgcagatggggcaagaccaatacaaataccttcaattaaacaaagtaccatactcaaacgtgtctccaacttaaccagagcagtttaggaaaaaaagcagagaactgtgctttctattaaacaaaaaacaacctgtaccctcaaagacaaaataacctttttttttgtttgttttggaaagacagagtcttgcactgtcactcaggctagattgcagtggcatgatcacagctcactgcagcctcgacctcccaggctcaagcaatcctctgaccttaaactcccaagtagctggaaccacaggtataggccaccacaaacagatttttaaaaaaatgttttgtagagacaggggggtcttgctatgttgtccaggttggtcttgaactcctgggttacagtgattcacctgctttggccccccaacgtgttgggattataggtgtgagcctgtgcctggcccaaagtaactttaaaaatattattatttttgagatggagttttgctctgttgcccaggctggagtgcagtgatgtgatctcggctcactgcaacctctgcctcccaggttcaaatgattttcctgcctcactcccctgagtagctgggattacagacacccaccaccatgcccggctaatttttgcatttttagtagagatggggtttcaccatgtggaccaggctgatcttgaacccctgacctcaagtgatccgcctgcctcagcctcacaaagtgctgggattacaggtatgagccaccacgtctggccaaaaaaaatttttttgagacatggtcctgctctgtttctaggctggagtgcaatggtatgatcacagctcactgtagcctcgacttccttgttcaagtgctcctcctgcttcagcctcctgagtagctgggactataggcatgcaccaccatgcctggcaaattttttatttttttgtagagacaggatcttgctatgctgcccaggctggtctcaaattcctgagtttaagtaatcctcccatcttggcctcccaagtaaaatcattatttattaaaaaacaaacaagcagccaggcgcagtggctcacacctgtaatcccagcactttgggaggccaaggcaggtggatcatgagctcaggagatggagatcctggctaaaacagcgaaaccctgtctctactaaaaatacaaaaaattagccaggtgtggtggtgggcgctgtagtcccagctactcaggaggctgaggcaggagaatggcgtgaacccgggaggtggagcttgcagtgagctgagatcacgccactgcactccagtctgggtgacagagtgagactccatctcaaaaaaaaaaaaaagcaaaaggggcttttcaatagtgtaccccaaatccccaaaattttaaattgtagctcatttctaactggggaactgttttctccaccttgagtgctgtctgccaatgaaagagtatggtttcctagtgctgtcttcactctagataaagcaatctacggtctaatttattaactgaatattttcttttatttttaaatttatttttattttatttattttttttgagatggattcttgctctgtcgcccaggctggggtgcagtggcacaatctcagctcactagtacccctctgcctcctgggttcaagcaattctcctgccttagcttcctgagtagctgggactgcaggtgtgcaccagctaatctttattttattttatttttgagacacagtctcgctctgttgccaggatggagtgctgtggcgcgatcttggctcactgcaacctctgcctcgcgggttcaagcgattctcctgcctcagtctcctgagtagctgggactacaggtacgtaccaccacgcctggctaatttttgtatttttagtagagatggggtttcaccatgttggccaggctggtctctaactcctgacctcatgatctgcccgccttggcctcccaaagtgctaggattacaggtgtgagccaccgtgcccggcctattttttttgaatttttagtagagacaggatttcaccatgttggccaggctggtctgggactcctgacctcaaatgatctacccgccctggtttcccacagtgctgggattacaggcgtgagccactgtgcctggccaaacattttcttttctaatagtatgtatatacagatagcctcagctgtactacactgcagtagacacttaaaatattaaaatatgtaaagttgaccatgcttcaatatataacacatttaaacacatggttttcatgtgaatgtcatcaataagggctctgtttatagcagaaaagcatcacggatgcttcacttgagatctgggaggagggggcaatcctctcggtagaatatatgtgagtgtgtgtgtcagaattaagtatatgtgcgaaaaaataaccagaaatttaataacaaggagaggaatctggtaacattactctaagaaaacatggaaactagttatctacaccacccaatttcactatgtcaattaaccatgatcatgctaggaaagttttgtatcacccactgttcaatcactaatgagtagcctgagaaaattacatttttttttttttttgagacaagtctcgctctgtcgcccaggctggagtgcagtggtgcgatctcggctgactgcaagctctgcctcctgggttcacaccattctcctgcctcagcctcccatgtagctgggattacaggcgcccaccaccacaccctttttttttttttttttttttttttttgagacggagtttccctgctgttgcccaggctggagtgcaatggcgagatctcggctcaccgcaacctccgcctcccaggttcaaacaattctcctgcctcagcctcccgagtagctgagattacaggcctgcaccactatgcctggctaattttgtatttttagtagagatggggtttctccatgttgaggctggtcttgaactcctgacctcaagtgatccgcccgcctcagcctcccaaagtgctgggattacaggcgtgaatcaccgcgcccagccgaaaattataatttttaacaattgcctcaattaaactcatccctaaaacacagcctattccctactggcatcttttggaatctgcaaacatgactctctgaaagaaaaacgttaacctgacaatatttccgatggctaacatttattggatcattaaatttgtgtccacaaaaccctgaggaagatcccagtgtatctattttataaatgaggaaactgaatttagagaggttaaataactcctgtaacatcttaacagctactaactgactatgctccgacacttaaaaaaaatactttttgattgaatgcacgtcaatcacaaggggcggggggcacaaattcaacgtaaaatctaaatagaaaatatcttctagtggccaggggtggtggctcactcctggaattccaacactttgggaggctgaggctggtggatcacctgaggtcaagagttcgagaccagcctgaccaacatggtgaaaccccatctctactaaaaatacaaaaattagccgggtgtggtggcaggcacgtgtagtcccagctactcaggaggctgaggcaggagaatggcacgaacccaggaggcagagcttgcagtgagccgagatcacaccactgcactccaccctgggcaacaaagcaagaatctatctcaaaaaaaaaaaaaaaaaaaagaaagaaaaagaaaagaaaatatcttctactatgctcattcatagtgacttcagaatttgtcatgagaacctgggtgatgaaatcatccttactcagcatttttattgcaggtgagtctattcacactgcacagctttaaaatttctgaattatttatgaatagtccccaatatatattcttattatataggctttaactatatgtgtatatgtaagaatgcatacatatagacacatacagagttagggcataagaaaaatgccctaaggaaaattgctaggatcacagaatctttgtgtcaaaaggaccatagatgtcacttggttccttatttacacataaggaaattaaggcctggcaaggttgagtaatttgccaaaggtcacaaagtagcagagcctgcgttatatgtttgtaataagaacctaattcttgtaaagcaccagggttccatgaggtatacagtgaataaatcattatctggtaccctcagatataggggctgatttttccctaaacgtttttctccaaatagattgcattaagatcaacactgataatattgccaatgaaggagtgtggatttctggcactgccttcattctagataaagcactatacaatctgacatattattttcttttataatagtatagccgtatagccccagctgtgctacactgcaatagacacttaaaatgttaaaatatgtaaagctaggcaggtgtagtggcatatgcctgtagtcccaggtactcgggaggctgaggtgggccaatcgcttgagcccagcagttgagagcaccctgggcaacacagcaagacccctgtctctaaattaaaaaacaacaacaacaaaaaaaacccacacccaaaattagccaggtgtggtggaggatcacctgagactgggaggtagaggctgcagtgagctgtgatcatgacactgcactccagccttggtgacagactgagactctgtctcaaaatgagtaaataaactatataaagctccttatgcctcaatacataatgatccaatggtaaagatcgacagtttccagaactctgagattcagcaaatctagaacctttccatcatagtcggcctcctgctagctcctcccctggcggctctgctagctttccatttcctacccagtctctcacttttcccccaaccccaaatgcaggtaggtattcattcccaaaagttttgtcttaggcttgtatctgcttattttctggtcaatacccagttcttgaagctcttatctactcccctatcttcatcaatcacctctccccagtgactgaacctaaacctccactgtcactttcatcctcagctccagattcaaatttccaagttccagcaggcagctgccctgtaatgttctaccagtacttcagactcaacatgcacgaagattaacccattttcctcttcatgaaaactcccaacgcttctcctaacttcccatttccctataaatggcacttatattttcctagttaaaattgtgggcgacatggcattctccctctcccttaactgcacagctgataaactgcccaatcctgtagcttcttcctcctcagtgaaaggaaactcctctcgagtacagggctggtaagttggattctctcaaaaggggccctgaagcaaggatgtgagtgccagcagttcatatggaaggcgacaccaggaagcacccgcgggagagtggcagagtgagtcaggaaaggcaggaagtcaataagaaaatgataccaggcagtttatggctgtgggcaactgggactcaagtccttgggatagtctgggagactgttgaacaaggcttacaatgatccccactgagtggcaaatgagctatttatccaccaattcccttttagccactggttgaagcctatcctggaggatgttaacgccccggtacttctggtctgccctaagtgcagttccagcaggctccgatggctagagaaggcccccagtcacagagatgcaggaagccctcaaaaaggcatacgtgggaatggtaagtgccaagggggtaaggatgtagcaccagctgtctttgctacaaggcctttttgcctctcacctggactgccacaaaactggttaactcccagtttttcttgataatcattcataatcctacatcattaatctacactatcagattaatcttcctaatgaacacttgcagctgtaatcatgacagtctttctgcttaaaatttctcattagcttttcactgcctactgaattaagcctctgccaagcattcaagactttccacaatatgacgccgagcaatccttccagctctgtattttattatttctccaaatgtacagatgcagaccaatgggatactgttctcttgcctgctaggccccttaatatccttgccacctgtgaccttcacctgcctggtgtccttctctgtcaaccttgcctgttgaaattgtgcatggaataaatgtcacaagaaggctgggcatggtagctcatacctgtaatcccagcactttgggaggctgaggagggtggatcacttgaggtcaggagttcgagaccagtctgaacaacatggtgaaaccccctatctaccaaaaaatacaagttagccaggtgtggtggcacatgcctgtcatcccaactacttgggaggttgaggtgggaggattgcttgaactcgggaagcagaggttgcagtgagccaagatcgtgccactgtactccagcctgggtgacagagttagaccctgtctcaaaaaaataaataaatgtcacaacaggtgagacttggcccctgtcctttaggacctcacagctgttctcaatcctgctaattgccctgtccagcctgctccatgccctatcccatgtgagtctctatcactgtcttttcacctctagctttgttaataaacccttgtcaaactgaactgacacacaggactaaaagggaggagacctgattaactaataagttctgatatacacaactatgcagttctatcgcacagccgcttgctgcttgatgggttccaacaggaaacatcatctgtcttctttcttcacaggagctgaagttagaaataagcacagcctacagaacttgggacccattaaagaatcacccagaatacacagcaaagacatttatggggcagtatattgaattgataggctttgcagaaactgtctccaggcctgaagatacaactagaagccttttagacaaaaaactctggttaaattctgttactcgggctagtaatgcaactggcagctatccttctggtagatgaaatcacatctaatcagaagagagacgaaggaagacctgggaggattctgctgggtggtgaaactccttctgggtgggatgaggatgggaaaaatgtaaaaaatccaaaagatatatcacttccagcagatatttggacataaacattcaataagttagaataatttgatgataattacaagccaaggttgtttaaattatccaactgtgactatgatcagagagcaatgacagtaatttatttattatcattattattttttatagaaatgaggtctcactattttgctcaggctggtctcaaactcctgggctcaagcaatcctcctgcctcagcctcccaaagtattgggattacaggcgtgagccaccatgcctggccaacaacagtaatttaatggctgaaagaggttagttttaaaagatgcattgaagagaatgaaatatcattaattactattattcatatataatagaaaaacaataaagcatatattttatatttacctatggactacatctaatttatccttcttaatcaactaagggcttcttaaaagctgacaagctgatttctcctgacagttttcttgtaccagatttagaaaatctgtttcagaatttaaaattcttttcattaaaaaaacaatttttgacctagactcaaattttaaaattccctctgttaatcaggtagccagactctccctagctattcttggaggagattaatttgctactctgcagtggaagccataactcagaatccttctctttcagggctggggttaccgcacttccaatgctgaactaagctatcgagaattttagttttctgtccagcaaagtgaaatctgaaaaagacacacgaatgcctggtaaaaaaatcatttacgtttcatattaactgtaatgtttgatgatcatcaggatcttagaatatttcattgagtattcctctctcaagtacttaatgatttgcactcaaatattggataagatgcatttaaatgaagtctgtgattcctgtgtggatgtgggcctccccaagaggaacaatgcttttaaaataggactaattatgctccttaattgatctctacagtgtgatgtggttttcattccacccatcccctgtccagtacctaacaaattgcctaagttgtccctaggaaaattgattttatttttggaatatgagttaattaaataatgagtcagacagaagaaaaattacttgcacataaataaaaccagcagtttaatgaaccatcatttcacccagtcattgatagacatattaaatgaccattgtctaaatttgcctgggagtttgctaattttaaaaatcaactacccataaaacaaagggccccaggaaatatcctggccagctttgaggctggcctctgtgtcacattcctgccagcgctccagatggcagccgtgcatgctcatgatgtcaggttatacaagctacaccaataaatgagcagttttgttagtggcttagagcaggtcagccaggaattattttcagtccaggctcctaagaggcaaatctcgtgactcacctgggtcatggaggctatcacatgcaggactactcatcacctcccagggattttcagccctgtttgtacattagactcaccaagaagtgtttatttaaaataaattacagatacctggactccacccttgaccaaatgaatcagaatctctgggggatggggttcagggatcaatattttttgagatggagtttcgctcttgttgcccaggctggagtgcagtggcacgatctcaggtcaccgcaacctccgcctcccaggttcaagcgattctcctgcctcagcctccgagtagctgggattacagacatgcaccaccacacgcttggctaattttgtatttttagtagggacggggtttctccatgttggtcaggctggtctggaacttccgacctcaggtgatccacccgccttggcctcctaaagtgctgggattgcaggcgtgagccaccgcgcccagctgttttttgttttgttttgttttttgtttttttgagacagcatcttgctctgtcacccaggctggagtgcagtggcagtctcggctcactgcaacctccgcctcctgggttcaagcaattctccttcttcagcctcctgagtagctgggattagaggcacctgccaccatgcctggctaatttttgtagttttagtagagaaggggtttcaccatgttggccaagctggtctcaaactcctggcctcatgcaatccacccgcctcggcctctcaagtgctgggattataagtgtgagccatcacacctggccagggatcagtatttttcaatgcttcccaggggactctaatgggtggccagagttgagaacctctgcaacaagagaataagtagggtgagagctaagccaaggaggatgctgcagtggtaagaatggtaaaacctttcttgagtgacttgggagaagggaaatccagttctatatgggtctgaactcttggattccttgaagtgtatggggaagtactcccaaacatctcataccttacaggatcacctgacacatattaagcatgatacctagctattaaattattatttctaaaactcttccattattcaacaaaacattctttcttttattttgaacttttttttttttttttgagctaggttcttgctctgttgcccaggctgcagtgcagtggcatgatcatggctcgctgcagcctcaacctcctgggctcaagcgatcctcctgcctcaacctcctgagtagctgggactacaggcacgtgccaccatgcccatatccagctaatttttaaattttttgtagagacaaggtctcattatgttgcccaggcctgtctccaactcctgggctcaagtgatcctcctggcttggcctcccaaagtgctgggattacaggtgtgagccaccacacctggtcacaatcttctacgtttaaaatttttgttattattggactgcacctatcaatgttgggagaaaattctcaaggattaaatgtgttcacacctacacctggctgagaccagccttcctgggttgttatatagaggaaggtaaggggagcaggaacaggttatttttgaagcatttaggaaagggccgacttgggtgcaacaatatgtccagtagggaggtactgcatgtgagaaaggcactgcctgaaggtagaagtttgaaactgaattgtgccttggctggccctgacctctatacccctcctccctctggctatcagggaggtcctttaatcctttctaaatgccttcttcagaaaatggcccacagtggggtggggtggaggaactggagggatggggtgggggaagaactctaagtccctcctacactactagcttccatggaaaagctagtagaaaacaaaaacagatttctctaaacctgagtccttaaccccaaagaatctgaggttggagggacgatcctctctctgaaaaccctccttccatctatccccagattttcaggctgacttgactggaagccagtactgaaaggtcaagacaccaggctgcacagcctgagttcctgccgtgagaccactcatcagctttatgacttctgattgtcaccccacttctccagaggtgtcctcatctgtggaatgaggtgggttttttttttttttttttttttttgagactgagtctcgctctgttgcccaggctggagtgcagtggcatgatctcggctcactgcaacctctgcctcctgggttcaagcgattctcctgcctcagccccccgagcagctgggactacaggcgcctgttgccacgcccagctaatttttgtgtttttagtagagacagggtttcactgtgttagccagaatggtcttgatctcctgacctcgtgatccacccaccttggcctcccaaagtgctggcgttacaggtatgagtcaccgcacccagcctgaggtggttttgttttgttttgtctttgaggatttgtggacctctgaagtagagccattcaaaatgccagttcaggataagctgctggcatcagaatgtaaatcagcaagctgcttctctcattaaggaaatattgcgatgagggaaaaaaagtcagcttatctaaaaagtgtacagaactgaaattggtttatgtgcttttaaagtatattaaccattatttaaaaaaaaataatttacaggccgtggacctggtagctcatgcctgtaatcccagcactttgggaggccaaggtgggcagatcacttcagccaaatttcagttacacaggaggcataagttcaagggatctattgtacatcatggtgactatcattaatggcaatgtattatatacttgaaagtcttcccatggtggagggagaaagctctgatgtctcttcctcttcttctacaggcactaattccatcatagggaccctgccttcatgatctcgcctaagcctaactacctccaaaggccgtgcctcctaataccatcaccttgatgggttaaggcttcaacatatgaatgctggggcagggaacacaaacattgggtctacaacaatattttatagccatcatgatgtgtagaaagtgctgacctgggagtcaaaaccagctctgaactcatccaccaaacttaggtaaatcatttactcatttaaatgttctcaggtaatgtatatgttgattagcttgatttagccatttcacaatgtatacatatttcaaaacatcatgttgtatacaataaatacataaaatttttgtccatttttaaaactaacttttttttaaggcagagtcttgctctgtagcccaggctacacacagtggtgtgatcttggctcactgcaacctctgcctcctgggttcaagtgattctcctgtctcagcctcccaagtaactgggattacaggcatgcgccaccacacccagctaatttttgtattttcagtagagacagggtttcaccgtgttggccaggctggtctcgaactcctggcctcaagtgatccacccgccttggcctcccaaagtgctgggattacccgcataagccaccgcatccggccttaagttggctgacattctatctcagctccttatcttgtctgggactagagtcaggtaccctgaggaaaagagttggtccacaggatacattttgggcagtgctgctttaaattattttccagcttctgcttgactttcttggccctcccttacctgctgagccagccctaacttgaactagaaagcacctaaaggaggattttctttttaaagctttatgagatgtaatttgcataccataattcatgtagaagtcaatggtttttaatatattcagtgttgtgccatcataatttaagaatatttttatcacaccaaaaagaaacctccattagcaatcatcgtccacctcaagccttaggtgaccattaatctactttctgtgtctatagatttgcctattttgaatatttcatataaatggactcatacaatgtgtggcctgttgagatgagcttcttcacttagcataatgctttcaaagtgcccatgcattcaagacttcattcccttttttttttgagacagagtctcgctctgttgcccaggctggcgtgcagtggcacaatcttggctcactgcaagctccgcctcctgggttcacgccattctcctgcctcaacctcccaagtagctgggactacaggtgcctgccaccacgcctggcaaatttttttttttttttttgtatttttagtagagatagggtttcaccgtgttagccaggatggtctcgatctcctgatctcgtgacccgcccgcctgggcactcccaaagtgctggaattacaggcgtgagccactatgcccagccgacttcattcctttttaatgtggaatagtattccaggatatggagctatcacattttgcttatccattcatctgttgatgaatatctgggttgtttctaccttttggctattatgaataatgttgctgtaaatatttatgtacaggtttttttacttttttgtttttggttatttatttatttatttatttatttttgagacggagtcttgctctgtcgccaggctggagtgcagtggcgtgatctcggctcactgcaacctccacctcccgggttcaagcgattcccctgcctcagcctcctgagtagctgggactacaggcacgcaccaccacgcctggctaatttttttgtattttagtagagacagggtttcaccatgttagccagcatgtgattcacccgcctcagcctcccaaagtgctgggattacaggtatgagccaccgtgcccaacctatttttattttttagagacagggtctctgttgcccaagctggagtgcaatggcacaaacacagctcactgcagcctcaaactcctggggctcaagcaatcctcctgtactcagcctcccaagtagctggtataacaggcacatgccaccacacttggctattttttgtttttgtagagacaagatcttactatgttgcctagactggtcctgaactcctggactcaagtgatcctcctgcctctgcctcccaaagtgctgggattacaggtatgagctactgtgcctggctcatgtataagttattgtgagaacatatattttcatttcaggaatttctgggtcatatggtaactctattttaacttttggaggaactgccagactattttccaaagtggctaggatgcttttcttactgggttaggaacacagaagtctgcatgatcctataactaaaaatagggaacccaagatcctataactttacataggatctataattttagttatagatcctataactaaaaatagctttctgtgtctacagatttgcctattttgaatattagttataggatctataactaaatttgtagcttttagttatagatcctataactaaaaatagctttcaacaaatcttggctgagttatttgtaaattattcctaaactaagtttacaaagtaatcaacaatgttagagaatttgtgggtagcttggattcctatccttgaaaaccaatctgcagagtagaagaaaaagtcctgtctattccaaggctcctagaaccctacaggaatatctgaggtttgctctactgagactaggactgtctgtctcctgcaggaaacagacccaaggagaaaaggtgtataggatgctcatttcctaataagaaaggccttgggctttccctcaatcctacaataactaattggaaatgaggacagaatggcagtggaaaatttctacttccttattctcctttgtaggagccatagtaatctctataaattctaagtatatctctaacattgccactcctaggagaactgcttaccctaaatttcatttcagctttgctagttcttgtgagctaatttctgttagagacagttccttcctgtttgatctctgctgattcatcttttgttcttttttatgcctaccctaaagtctcgcttactctgggtctaagctacattaaattatttctggaacaaggtgaggtataaataaacatcagagttcctctagtatgaaacagtaattgttcttagcttgaagacagaaagaagcaggattatcaagggatctaaatatcaacgttagctctaataatcgatattagcatctcattttttgatccaactcaaaaaagagtaataaggatgtagaataaccaaaggtaattatgtccatttagaacaagtactttaaaaaagaaattcaaggaagtaaactaattaattaaatgtatacttcttataccctaatgatctaacgagttaatacagtagtagttatgccttgggttataaaaaactttttttaattttaattttaattaaatttttttgagacggagtctcgctctgtcgcccaggctggagtgcagtggcacgatctgggctcactgcaacctttgcctcctggattcaaatgattttcctgcctcagcctcccgagtagctgggattataggcatgtgccaccatgcccggctattttgtatttttagtagagacagaatttcgccaagttggccagactggtctcaaactcctgacctcatgatccacgcacctcagcctcccaaagtgctggaattacaggcttgagccaccgcgcctggcctatttttattttttattattttttaatttaatagagatggggtttcgccatgttggccaggctggtcttgaactcctgggctcaagttatgtgcctgcctcagcctcccaaagtgctgggattacaggcatgagccactgtgcctggccctaaaaagctttatcttacaagatatttcaagtttattatttctttttgtttgtttttgagatggagtcttgctctgtcgtccaggctggagtgcagtgatgccatcttggctcactgcaacctccacctcctgggttcaaatgattctcctgcctcagcctcctaagtagctgggactaaaggtatgtgtcactacacctggctaatttttttgtatttttagtagagacagggtttcaccatattggccacgttgatctcgaactcctggcctcaagtgatgcacccgcctcagcctcccaaagtgttgggattacaggtgtgagtcaccgtgcccagtctcatgtttattatttcatgtgaacttgaaacatccttgtgaggtggcaagtacacattatcatattcagttaagaaaaagagaaacagaaaggttatttgacttgtactttatcacttatagctggttagtggtgacaaccgaacttgaacttgggacttctgagtccgaggtactttctgctacataaacccaagctgcctgccagactgtaactctaacagcttagtgtgttattagctattttgagacacatatttgctggggggtactagttaatcaaaatttaactgacacactgtgtaagactccagagacccagctactcttacgttacttagaactcagtgaattcttcctggaggtttttcaaaaatacaattaaagcttatgggctgaaaattactgggttgctgtactatttcaaagcaaatttctaatttaactttaaatactaaggagagtatgtttttaaagtatccttctcctctttttctctcctccttcctatttgttgtttctttttttctttttcaaatgtgtgtgtgtgtgtgtgtgtgtgtgtgtatatatatatacacacacacatatatatttgagacagggtttccatatgttgcccaggctggtcttcaacttctgggctcaagtgatcctcccacctgggcctcccaaagtgttgggattgcaggtgtgaaccaccactcccagcctgttgtttcttaagcttctaaccaccaatctcccctttcactctacacgtgccctaactaatctcagctactcctgagcttcaacttctacctgcacactgataatctcagtctgtctctctcttgcttgcctatttctcctgaaggccagtccagtacatccaaaaacttactgaaaatttccaccgggattatctaaaagcaccctaaacatctaaaatggaatctgttatctttgttacatcataatctcacaaattcttctaaatttcctatttcagcaaatagcagcatcttccatcagccagccaagctagaaacattaccctagactcccttgtctttacttcccacaatacgactaatactattttcttccccttgaatactactcatttttgttctctcgtctttattccccctccgtctgctttcaaactccaaactccatgtaggtctgtagtaactgctttctaactggcctcccagcctccagcctccagcctccttcccctccatctctttctttcctacacaccactgccatggttctctttctaaaacatgaccatgatcaaattatgcccttgcttcaaaatatcaatgattcaataccaggttcttaggagtctacatgtgattctggccctacccttctagcaaattcctgtcacttccagaaaagtaagaaagcataaaacataatggtcaaaaacataagcacatagatcacctgggtctgaatcctggctctgtcatttgttgggaggggtaagttcctaacctaccagtgtcttgttttcttcatctgtaaaatgcaggacaggggccaggtgcagtggctcacacctggaatctcagcactttgggagcatcgcttgagcccaggagtttaagagcagcctgggcaacagagtgagaccccatctctacaaaacaaacaaataaataaataaaaaatcagccaggcatggtggcacacacctctggttccacctacttgggaagctgaggtggaaggatcacttgagcccaggcggtcgaggctacagtgagccatgattgtgccactgcactccagcctgggcaacagggcaagaccctgtctccaaaaggaaatgagggataatgggggctatacttacctaaattgttgggctgtttctatttctgaagattaaataggaaaagacataactgatacattctacggattacataaatattagataaaattatcatcatcatccagccatagtaagtagctgctactgtacgcactttataataccttggtctttgcgctgagagagcctctctccccgctttggaggttcaataccacagccttcaagatccaactcagaacgctacctcctctctaagctctcccacctcccccaggcgctttgttactctttccctttgtgctctgtagccttaacaaaggctactgttaaacacttagcactgtgtatattttaatggacttgactgtctctcccacaactaaagtttgagctcctaaagattagggctgtgtctcattaatatgtatatcttcaccctattggcttgcacagtgcccgatttaacaggcacataccacggctctgctgaatgaacagatctttgtccctcacttcataaagaactaacgagcttggctttgcagcacattatttccttgagagcctcagaccatgtcttcccccccggctttgtgtcctggaagaatgcacagcagacaggagctgctcaaaatgatttgcctgggccagggccacagtgacacattcaaatctttccctttagagtactatctgtctacgagattcctaaagggctggattgaatgagaaaacgtgaaccttcacgtcaagctatttattacaaggcacttgagtaagaccataacactctgcaacttttgctttcgaaatcgtgttgatcttcatttcctccagtgcctaagtcactgtaaagccaagtacaagaggtttttacttcccaagttcttataaagtgttgacatttgtgacctgattgtaaatttttatttccagcatgacttatttatagtcttaatgtcattctctatcaatgacccaaaaaaagtttctttcaattctagtagaattgcctttgacctgttgagattgtaaaaagttaaaaagctgaagaaaattttagcaagtggaatatttctcattccaactcacggatttaaagatcagatagagtgattttctaagaggtgaaagatctatcctagcaaaaactcagaattagagggggaaaaaaagacctgatataaattttaaaaggtttcaataacattcccaccatgtaaacttcagctggcaaacaggcatgtgacatacaaaattgtttcatgacaaatgtaaatttcataagtggaaaaaaaatcactgtattagttaatttgttttgcactggttaatttttaaggaaaatgtgttttgcattaaaaatgaggccttctcttcccagttcttcccagagtcaggaaaagctgggttgagagggtagaaaaaaaatgatgtaggtgaataactatcgatgttaaaatgtagtaagtacaaaagtttagttacaaaatagaatcttaatttttataaaaatagaaatatattatatatattttatttatatatgaaatctgaatgaacacagactaagggaatttccttggttatacaattatcggtcttgtaaatttcctttttttccatatctgtatttttgtataataaatttgtattgcttacataaacagagttattttaaataaaaagaatatgctttttgttataaaactagaaatgattctttaaaaagttaagactgttgtcatttaaatttacttaccaagagattctcccccgccactcctctgttgttaaaaaccacacatctaaaaaccaggaaagcaatttttgttatttttacacatgattcttgctcatgatataatattaaagtcatcttactgacactgatttagagcactaaaagattttaaaaatctgtcttgtagttgtaatgtttggcaatttcatctaaatgcaatgcactaaaataaaattccagttctctaaattccacatgtgggttcaaattagaaaactgtatactgaagtgatgttaatttttcctaccaagagtagactatttccaacttcttcctacgcacatacgtgggcctccaacaagtgtttttaaaacaattctaaatacaagtcaaatttaaatgtttttgctttttttttttttttttttttttgagatggagtctcgctcttgtcacccaggctggagtgcaatggtgcgatctcggctcactgcaacctccgcctcccagggttcaagcgattctcctgcctcagcctccttagtagctgggattacaagcacccaccaccatgcgcggctaatttttttttgtatttttagtagacacagagtttcaccatgttgaccaggctggtcttgaactcctgacctcaggtgatacgcccacctcggcctcccaaagtgctgggattacaggcgtgagccactgcgtctggccttgtttttgctttaaacaaagaaaaaatatatatcctctacccattgcatttgtaacattcatacgtatctatttatattctaagaaacagctcttgttctcttaaggctcagcaaacatggacaccagaattttacatgaggtgtaaacatcacaggtgagccacaaagagcctggcacctgagctggtgggatgggccccattatgctactgcttagtgttcagttgacctagggaggaaagatgaccttgtgctttctctgatcctgtttgcatctgctgggtaaatgggctcagatcaatgtaaagggtttagatcaatgttggctcaagtaagtactcggtgaaagttagctattagtaataatggtagttgtagtgtcgtgctggtttcaaaagttattcagtatttaaaatatgtaactctcatttaactttcaggcagccacaggcccagatatgtatttttaccatccttagacaaaatcttgatttgtgtctacacaggttctcactgatttagtgagtctatattcataacaattaaaattcatttagtttttgtctgattacctattcaaccaaccaaggccatttaagattccaaatctcttcttgcagggtgctgctgagcactgtacaggttctaagcaacaaagaacctactgctgtatagaacatacacaactctgagtctcttctcagggagtttagatctcaaggcacaccagcttcatttaatgtggtatgcaggctatgttcttgcaaaggaattttcttgcaactgaaaagccatatagaaaattttattaggcccagttgaaagaagagaaatgtttagaaacctcagaaatcctatttgagaaaaagctagaaatattacattttattaactcacctaagataaatctttttgttttttgagaccatggtctcactctgcaactcaggctggagtgcggtggcgcggtcacagttcactgcagcctcagcctctcatgctcaggcaattctcctgcctcagcctgctgagtagctgggaccacaggtgcacaccaacacggctcagctaatttttattcttttttttttgagacagagtctcgctctatcacccacactggagtgcagtgacatgatctcggctcaatgcaacctccatctcccagattcaagtgattctcctgcctcagcctcctgagtagctgggataacaggcacgtgccaccacgcccggctaatttttgtacttttagtagagatggggtttccccatgttagtcagatcgttctaaaactcctaatctcaagtggtctgtctgcctcggcctctcaaagtgttgggattacaggcgtgagccaccgtgcccggccagcctggctaatttttataagttatttgtaaaaacaggatctcaccatgttgcccaggttggtctctaactcctgggctcaagtgatcctcctgccttggcctcccaaatgctgggattacaggcatgagccactgtgcctggccagagaaatcttaaataaactgtaaatacatacagaaaagtcagagtagtctcagtgactcctttatcttttcttgctaaaaacaatggcaagatatcttgatataaataagatttcagttggccatttgtatttacttgcataagcacttaagtcacacaggaaccggtgctaaagttaattatgatcttgaaacttgaagctcccagtcattcagaaaagaaccactttagagtacaaacattaaataaggattaaaatggcttctggagcaagatgtcatcatgtgactgccagtgagagaaggcaagaacactagtgacgggaaagaaaaagatgatctgcaaactcatgaaaaagcagcctgtacatctgggattttcttctaaactgcagagtgggatatttgcactttccttcaggcaactttggaaagtggatcatagttctggtagctcttgctagaggacgaattgtactcaccactccataaggctttgatcctaacagtgttcaatcagtagcagtcatcattgtatacttaaagccttggacgtggggcagagagataaggaagaatgaggaagcaaagcagttacagaggacggcagaaagaaggctgccatcctgccctttctcccactccagctggggatgagcaaccagctcttttcatttaacccctttgctactctgacagtcatcagggaacactgaactaaaagggctggctgtgaaactactattcctaaggcattgaaaaatctgttaacctcttcttctttttttctttagagataaggtctcactgttgcccaggctggagtgcagtgacacaatcacggctcactgcagcctcaacctcctgggctcatgtgattctcagcctcccgagtagctgggactacaggggcatgccaccatgcctggctaatttttaaactttttgtagagacggggtctccctatgttgcccaggctggtcttgagcttgtgagctcaaaacaatcctctcgtcttggcctcctgaagttctgggattacaggtatgagccactgtgcccagcctgtttttatttttttttgagacagagtcttgctctgttgcccctgctggagtgcagtggcgcaatctcggctcactgcaagctccgcctcctgggttcaagccattctcctgcctcagcctcccgagtagctgggactacaggtgcctaccaccacgccaggctaattttttgtattttttttagtagcgacagggtttcaccgtgttagccaggacggtctcgatttcctgacctcgtgatccacctgccttggcctcctaaagtgctgggattacaggcgtgagccaccacacccagccgcctctgttaaacttctgtaacagttctctccaattaatttttacagttacctcaaacaattctaaagggcgtgtatatgagggaaattgttctgcaaagcatatttttcctacatatttgaactatataatttttttccctcaaaacaaggaaaacataaagagaagaaatatcaaataaagaacagatctggtaagaagaactttctgtgacaagataacccattaaccagggaaacaggtgggtgtcctttaatgaaggttaaataaaaggaagagactacctatagcacagagtttctcaatctttagtactatggacatttcagcccaaataattctttgtagcagtgctgtcctgtgcattataggatactcagcagcatctctggcctctaccaactagatgccagtagcacatgccccaggcataacaaccaaaaatgtctccagacattgccaaatgttccctgggggaaaaacggcccctaggatgagaaccactgtcacagtgagatggaccagagaaccttgaatctgctcaggcttgaaccctggaagtcaaggttgcagtgctgtgatcacaccaatgcactccggcctgggtgatggagagcctgtctcaaaaaacaaaaacaacaaaaaaagtagcagactctgagcttgggcacctaagaaaagcagtgaaacttccatgggttgtgagtacctgtctaggcctagtttccaaatctgtaattttatcaggcaatctgaaatatttcagttctaagattccccaaatcttcaagtctaacaatagaaatgataatcagcaaagggtagaatgagaggaacattcagagatcagctagtcatatgattgatttcaggtaataataataacaacagatactgtttactagtgtttactatgtgccagatcatgttctaagcactttacatgaatattaatattggaataactcatttattcattcaataatatttactgaactaaagattgagttagagcctgtagtagagaaataaagtatcaacataaggttcctggcctcaaggagggtacaatctagttagattgaaaagatttgcaccatattttcagttgagtgactacaacaaaaaacaagacagtataggattcaatgtccaaggagtggtatagacaataaaaccctatgaggtcaggatgggcaaaattgattaagaaaggcttcataaaaggtagacagatcttatgttaggacttgaaaaacagtaaagattccagcaaaaggcaagtgtgagatacattgtaaagggagtaatccaagcaaagatataaggtgagtatgtattaaatgttctaagggacgaaaaatcaattatcagttgagaagtggttacacggacagtaacaatagaaaataagaatggaaaaacaggttaggacaaaaataaacataaggctctgaattccaggtaaagaaaagataaggaagttctgcctctagtaatgtccaggtagatcctttagggccaaactttccatggaataataactatacattcttgaaaaaatataaaggcagtagagaacaacaatgacaacaaaaagcatgcagaaactgaatgggagttgacactaggaaaatgaaaatcatactgggtgagttttcaatttttacagcttctcctttttttacctgagggaaggcagtagttgggtattactcaatgataaataaaagttggatagaaatgcgcagtctcttggctgggcacagtgctcatgcctgtaatctcagccctttgggaagccaaggtgggtggatcacctgaggtcaggagttcgagaccagcctggccaacgtagtgaaacactgtctctactaaaaatacaaaaattagccatgcgtggtggcaggcacctgtaatcccagctacttgggaggctgaagcaggagaattgcttgaatccgggaggcggagtttgcagtgagccaagatcacaccattgcactccagactgggcaacaagggtgaaatctggtctcaaaaaaaaaaaaaaaaaaaaaaaaagggaaatgctcagtctcacaggcttgaagaactattaaaacagtttggggcaacaatagaagttgaaaaacaagcagaaaaaaatcttagaatggatacacagagaaagagcagtaaattctgactaaaagctgggcccaaatctctagttgatccctcatctatacatatgtgaaacacactacaagcaacccaattaaggctaaaaaactggacaaagatttcaactgcaatttacaacagaggagagagagtttgaagtttgagtgcagccaagttaactatctaataaagcaaacaaaaagcaacactctttgcaaaagtataacagaatccagagtctctacaatggatcactcaaactgtccagaacacaaccccaaattgctagaccatgaagaaacaggaaaacatgacccacactcaagagataacctaactggtcccgagattgtccagatgttagaactagcagatgaagttttacagtagctactataactcaaggacattaagggtggtggggtgggggagcttgtaaagaatttaaaaaaaaaaaagaaaatctcagcataataaaatttattaaaatggaaattctagaaaaaaatataaaatctgaaataaaaaattcactggatttgcaaattgcagctcgaacataggataagaggaaaaaggtccaaaaaaagtagaacctcagtgatttgtgaaacaatataaaaaaaaaacaacatacatgtaattgtgggcacggtgactcacccctgtaattacagcacttcgggaggccggggcaggcaaatcacttgaggtcaggagtttgaaaccagcctggccaacatggtgaaaccccatctctactaaaaatacaaaaattagccaggcgtggtggcaggtgcctgtaatcccaggtactcaggaggttgaggcaggagaatcgcttgaacccaggaggcggagcttgcagtgagtcgagatcatgccactgcactccagcctgggcgacagagcaagactgtctcaaaaacaaaacaaaaaaatccaccacattaacaattacattaaatgtaaatgaataagaacctcaattaaaagatggagattgtcagacaggatttaaaaaaaagcaagatctggttgggcacagtggctcatgcctgtaatcccagcactttgggaggccgaggcaggtggatcacctgaggtcaggagtttgaaaccagcctggccaacatggtgaaaccccgtctctactaaaagtacaaaaattagcctggtgtggtggtgggtgcctgtaatctcagctacttgggaggctgaggcaggagaactgctggaacctgggagaaggaggttgcagtgagccgagatcatgccattgtactccagcccaggtcgacaacagtgagactctgtctcaaaaaaaaaaaaaaaaaaaaaagagcaagatctaactacatgctatctacaatacactttaaatacaatgacatagatactctgaaagttaaagtgtaaataaagatatatcacacaaacactcagcaaaaaaagaacgaagtggctatgataatatcaggtaaagcaaacttcatgacaagaggtcaagaagaacatttcatgatgataaaaagttaattcataggaagactaacaatcttaaatgtgtatgtgtctaacagagcttccgtatacatgaagcaaaattaatagaattaaatggagaaacacaaaatctacaactatattttaaaatgcttctatcgataaaagataaaagtgagctatagtctgaaaaacattatcaatagtaaccaaatttaaatgtacagaacaccacatccaacaagagaatacacattcttttcaagaaatgatgctatctaaacatttccaagcttactaaggtcataaaggtggtaaaacaaatgaacataattcacgtacctttttctaagatgcttcagaaatcaaacgcagtaattaatgtgagtatattattcactattacatgcctaactcatgattatcatatggtaatggagaacactgaaagtcaattcataattcaggaacctcattatctcccgtttcaactctttccctataaaatctattatctgagtaggaaacatgatttatttgcctgtcatgtcttgaatttccctgataaaactgagtcccaatgatatcacaggtatgcattatcatattaagcaacaatcatgggattggaagagctagattttcccaagctaagagcctaaggcatccaagggtataaaatagtagtaaagaagggttttcaggaactatcaacatttcaaaaagcctcacagaaatcatatgtttatctgtaataagcctgtacattccaatcttttcttttttaagacggagttttgctcttgttgcccaggctggaatgcaatggtgcaatctcagctcactgcaacctgtctcccaggttcaaacggttcttttgccttagcctcccaactagctgggattacaggcgtccaccaccacactcggctaattttcgtatttttagtagtgacggggtttcaccatgtcggccaggctggtctcgaactcctgacctcaggtgatccacctgcctcagcctcccaaagtgctgggattataggcgtgagccaccgcacccggccctacatttcaatcttaaccctgtcacacaccagctaattttgatcaaattactaacttttgttagtaatttctgctttttgtttggtaaaatggggtttataatatgtatcttgaactggatatatactaagtaggataacctatatataatgcctggcatggggcctatcatgtggcaggcactcagcaaagctgaatttaattgtaaccaaccaaagtggcaattctggttatttcttgctgatcataagttctaagcggccctatgaatttttttaaaaaaagaatagcaagttaatatttaattaatgcagtttattttttaggtatatttcaaaaccagtgggcacaagggaaaagagtcaaaggtgtctttaacgtgaggaagctggaaacgaatgatacaaccagcatggctaattcttccagtgatcttattctattttattgcagtcgtttcccttctctgctttagctgtgatcctaaaatttactcagctgctttctgatgttctcatatttcatttcactcatttgatttctagctgtgtctctttggtatttttgcagattttgtcaataaaacacccagttgaactggccctatttaataagcaaagtgctctaaatttatagtgcttgtaagtaacagttgttactccagtgtcacaagtcactgctggaaactatattacccaaaacaaactcagagacatggattacaggacaatgtcgattccagcggccactctaccttagcaagacatttccttccttctctctgtactaccctttggcttgccaggcacactgttgtctctgggctctcttggagtggcatcttcttcgtattaataacagtaaggcgtaggcagtatctcattttaatctgaccagattacaacagtggggctctttcctaagccatacaatggtcctaattcacttcttaaggtttcatagctaacacttaacaaaatgtttgccataggccctgtactagtcaacattctttatacacattacacgcaatccacacaaccctgtgaggtctaggtattgttacagatgagaaaacaggtgctgagcaatgacataatttgtctgtgggtaggcaggtagtgtatgacagagttaggatctgaacccaggcagatccgactcaagaatccacttaaccacctcacttcactgcccagcactacctaagctgtaacactcaggtctctttttccaaagaagacgggtgctctgaacacagagtaccctttgagggcatgccaactctgataaaaagagctttgtccctgaaggtttaattgaggtgccatgttgcagtggaacagctaacaattagtgccctagagaatgggaccacttgtcagtctccaccataactttttctggaataccaagaaagaagctaacctcttcattcagtgctttctaacatgcattactcaatctggctagtctcacaaatgatcagttaactgccttattcccaaaagtttaaaaaccaaattattttaacaacaacaaaatgagttactgagaaaaaaatattctggtgttaatttaaaatgatttcttatctaagacattgcttttagatgagggaaagcgtggtcagaactaacccttttgttttgctgtctcgttttccttagttcagcctctctcatctctcctccctcaggaagtctgtagctagactctccacccctgtcccccaccaaggcacctctaatgctgcaggaaaagctaaattgcatctagagctatgataacttcaaatgacatttacttgctacttcctctacataaaatattctcaggatcacatttttttttaaaatttatttttattttttttgagactaagtctcgctctgtcacccaggctgtagtgcagtggcacaatctcggctcactgcaacctctgcctcctgggttgcagtgagcccctcgagtagctgggattataggtgggggccaccatacctggctaatttttgtattttttagtagggatggggtttcaccatgttggtcaggctggtctcgaactcctgacgtcaagcgatccgccggccttggcctcccaaagtgctgggattacaggcgtgagccactgtgcccagccagtaccacatttagaagcaaattttaacaacttttaaataatctcctacactgagtctctcaagaatataaatgatgaacggtgacatccttgctaccagtaggtgggctctgcaatgaagaataagagatcctaattctgtcaaaccataccaaaaaattagttttttctctaagtaggaaataaagtaacaagacagtaagaaatgtcttaaaacacaagtttacaatcttgcaaaaatccctcgagtgatccttttgccctcttctaacaactgtcctgtttctctcctttctctgtcaaactcatcgaatgggtgatccattcctgctctgtctactgaggtcatctatccagcagtttggcttccttcctcatcgctctactgagattctcatgttttgctttattcatcctccttctcctttaagttgtatgtgacaccgctgatctactccttccctccataaaatgacccttttggctcttctgatatttctgaatcccagtactgccaactcttgactactcagcggcacgagctgctagtcatctcccaatatccatccttcccttcttcctcagcaacagaactcccaattttaattgggacatggctgtccaaaataaagatatgattttcttttttttttgagatggagtctcgctcttgtcatccaggctggagtgcaatggagcaatctcaactcactgcaacctccgcctcctgggttcaagcgattctcctgcctcagcctcccaagtagctgggattacaggcacccgccaccaggctaaagtttttgtatttttagtagagatggggtttcaccatgttggccaggctggtttcgaactcttgtcctcaagtgatccgcctgccttagcctcccaaagtgctgggattataggcgtgagccatcatgcatggccaagatttaattttcaagcttcccttgcagccaagagcgggccaatgtgatacaagcaaaagtggtgtgcacaattgctgggctgcatctttaaaggaagatggtacctttcctattcctgctttttttctccttcttgggtgttagaatgcagatgtgatggctactgctgaagcatccatgttatgaagcaacatgttaggttggtgcaaaagtaattggggtttttgtcattaaacataatggcaaattacttttatttttgccattacttttaatggcattaaatttgccattacttttaatggcaaaaaccacaattacttttgcaccaacctaagaataaaagcagcttaggttcctgacactgacatgtgccatacaagccgtgatctaccttcttagatttttacatgagagaaataagtttataccgtcactactattttgagttttttgtcacttacagccaatcttgctcctttctgatgtacatttccctgctgctgctgcacagtctttgccacttcaactagactgtatgctctttgggaataggttctgatattgtactttgcagccccaaaatacttatgactgacctagatttcaatgaacttacaactgtataattctggatgggtcattcttgttaatattagttgggggtggaatacaatggtaaatgaaggctctcggttttatttttttaaattttaaatttttttctttttcttcccccctagtaataatggctctcaattttaaaaagtcaaaagatgattcagattttgttggagttactgtttttctccttgtttttttttttttttgagatggagtcttgctctgttgcccagactggagtgcagtggcgcgatctcggctcactgcaagctctgcctcccgggttcacgacattctcctgcctcaacctctcaagtagctgggactacaggcacctgccaacacgcccggctagtttttttaaaaaatatttttagtagagacagggtttcaccgtgttagctaggatggtctcactctcctaaccttgtgatccgcctgccttggcttcccaaagtgctgggattacaggcgtgagccaccgtgcctggcctttctccttgtttttgttgtagtactggaaatcaattcagaaaatggtaaaaggatttaagaaaacaagatattattaatgtacataaaataatacctattaggctatattactggagattttttggaatgaatggtaaagtttctaactactttatcaatcatataggtataaattgttagagaaaactgccttttctccagctttctggtttccatgaagagggcttctctctaaacatatttctggtcttttattattattattcattgttattatttagttttggtttttttttggtagaaatggggggtctcactatgtggtccaggatggtctcaaactcttgggctcaagcaatcctcctgccttagccttccaaagtgctgggattataggaataagccactgcacctggcattcctggcctctcttattttatttaccttccaggaggtggtagacataactgattaataaaatctgaaagaatttatctggcttagcaactttctcctcttgcgggcaggaactatccaaaagagtacatactcaatccaccagtgaagatggacaggttatcttcatgtaggcaggccaaacatttcccatctcattctattaactttttttttttttttttttgagccagagtctcactctgtcgccctggctggagtgcagtggtgcgatctcggattactgcaacctccacaacccaggttcaagtgattcttctgcctcagcctcctgagtagctgggactacaggcacgcaccaccatacctggctaatttttgtattttagtagagagggggtgtcaccatattggcaaggctggtcttgaactcctgacctcgtgatcagcccacctcggactcccgaagtgctgggattataggcgtgagctaccgtgcccagcctatttatcctttttttaaaaaaactgagacagagtctcactctgttgcccaggctggagtgcagtggcatgatcttgactcactgcaacctccacctcccgagttcaagcgattctcctgcctcagcctcccaagtagctggaattacaggtgcatgccatgatgcccggctaattgtttgtatttttagtagaaacaaggtttcgccatgttggccaggctggtctcaaactcctgacctcaagtgatccacccgcctcggcctcccaaggtgctgggataagaggccagagccaccatgcctagcctcattctatttacctttgacttacatagtaaagcgtttgctcacaattatcttaaacaaacttaagcctagtttccatcccatccatcctgaattttgaattagtgcaccttaacagaaaagtactttgttagttttcaggtagaggggaaaaaacaatggtttaacatcaacaataaaccattatgtctcctttgaccatacgctgggagttaggttctctctaatgtctaaatcatatctcgtatctcaccagtaaatcattgacagttccctggtgacctgacataattcatgactctccctaaaccttcaacctttacacaaatagtaactgggacaggatggcaagtgcaccctgcgcctcagggatgttcatactgaagatactgaaactctcatctatagcagacatggtaacatctatatactcccacaaggaaactacatgtttctctatcccaagaggtagatttgcttgtactcattcttttgaattataaaacattttcttttttttttttgagatggagttttgctctgtcgcccagcctggagtgcaatggtgcgatctcagctcactgcaacctccgcctcctgggttcaagcgattctcctgcctcagtctcccaagttgctgggattacaggcacccgccaccacgtccagctaagtttttgtagttttagtagagacggggtttcaccatgttggccaggctggtcttcaactcctgacctgaggggatctgcccacgtcggcctcccagaatgctgggattacaggcttgagccaccacacccggcctataaaacattttctaccctggccagggaatagatgatgagggaagtaagacataaacattttcttttttttctttttttaagacagagtcttgctctgtcacccaagctggagtgcagtacctcactgcaacctctgtctcccgggttcaaccatctcggcccactgcaacctctgcctcccaggttcaagcagttcttctgcctcagcctcccaagtagctgggatgacaggtgtccaccaccacatccagctaatttttctctgtatttttagtgtagatggggtttcgccatgtgggccaggctggtcttcaactcctgacctcaggtgatccacccaccttggcctcccagactgctgggattacaggcgtcagccactgtgcctggctgacataaacattttctaaagacccactttgtgcagggcacccaaccaagtactttacacttttttttttttgagatggagccttgctttgtctcctagactggagtgtagtggcacgatctcagctcactgcaacctccactacccaagttcaagcgattctcgtgtcttaagattcctgagtagctgggattacaggcgcacaccactatgcctggttaacagggtttcaccacgttgaccaggctggtttcgaactcctaacctcaagtgatccacccacctcagcctcccaaagtgttgggattacaggcatgggcgaccacacctggcctactttacacactctaactaaaccctgtgaagtagatgagaacgctgtgatgagggaacttaaattaactggccagggtcccttagaaagtggcagttcgaacatttgaatccagcttgattccaaagcccaaacacattccgtcatattacacagcttttcacaaaccctgttatctgctagatcccatgctacagtaccaatgacttagatcattttggtacctaaagactcaactcagccttgcgccaaacttccagatctatttttattcttagtggtctttaaaactacctggctttctgtggtaggttgcaaaaatattttgaagctcttcctatcaagaggcagagtctatttccctacactttgactctgggctgatcatgtgacttgctttgaccagtagcactgtgggagttctcagcctgggcctcaagaggccctgcagcttctgcttttgtaattttgtgtgtgtgtctgtgagatagagtttcgctcttgttgcccaggctggagtgcaattgcgcaatcttggctcactgcaacctccgcctcccgggtttaagcgattctccctcagcctcccgagtaactgggattataggcacgcgctgccatgcctggctaatttttgtatttttagtacagatggggtttcgctatgttggccaggctagtctcgaactcctgaccttgtgatccgcatgcctcagcctgtggatgagtgctgggattacagctgtgagccactgcacccggctaaaatctggcaacctttataagcaatggacaaaaggtatgtgcactggcaactccagagcttataagactcagtccttgagtttcaaccacattgtttttatttatttatttttatttatttatttttttgagacagagtctcgctctgtcgcccaggctggagtgcagtggtgccatcttggctcactgcaacctctgcctcccaggttcaagcaattctcctgcctcagcctcccgaataactgggattacaagcatgtgccaccacacctgtctaatttttttgtatttttagtagaaacagggtttcaccatgttggtcaggctggtctcgaactcctgaccttgtgatctgtccgccttgacctcccaaagtgctgggattacaggcgtgagccactgtacctggcccaaatttttttgtttttattttttttgagacggagttttgctcttattgcccaggctggagtgcaatggcacaatcttggctcactgcaccctctgcctcccaggttcaagcaattctcctgcctcagcctcctgagtagctgggattacaggtgcccaccatcacacctggctaatttttgtattttttagtagagacgaggtttcaccatgttggccaagttggtcttgaactcctgacctcaagtgatccacctgcctcggcctcccaaagtgctgttattacaggcgtcagccactgcacctggcccacgttgtttttaaaagcagttctaagtcttgagagacagctcaggccaaatctagaagcagtaatttaaatatgtacaaaaggcattatgatcttctgtactttctgagcatgactaagttttagccaaaaaaaaaaaaaaaaaaaaaatggaaccaggctgggagcattaactcacgcctgtaagagactgcagtgaaccatgatcatgccactgcgctccatgctgggcaacagagccagatttggcctcaaaaaaaaaaaaaaaaaaaaaaaggaaccaagcctcacatctaactgtatggtgcttaaacatggaataatgatgaattcctgctactgctaagcaaatttcttgaatataattcttgaacatcatagttcttgagagaatgttacttcatggacaaaataggctattatttataaaagatcagaattaacttgttaaaattaagttagctatcatggaattttcccctttacatcaaacatcaaaatgttcttctttccttttttttttttttctttttgcccaaggtgtcactctgtcatccaggctggagtccagtggcacgatcatggttcactacagtctctacctcccgggctcaactgatcgtcctacctcagccttgtcagtagctggaactataggtgcatgccaccatgccctgctaatttttgtagactaggtctcaccatgttgcccaggctggtctcgaactcctgggctcaagcaatccaccggctttacgccttccaaagtgctgggattacaggcatgagccactgtgaccagcctaaaattatttttttaaggtaaacttaccatcagcttttcacacaagtgtttcaagtttaacaaaagatacaactctactttaaatacaactcacagagtgttccattacaataattatcagctaaaaaaaaaagctgaggcacaaaaaagcagtaccttttataatgactctaagattctagagctgaacttgaaactcaaagttgctaatcacttgcaaaaaattaaattgtacctggtgactgagcttaataatggttactcagaaaagctgtggcatcaacaactggagactagccaagtgcacctgcaaactcaggtggtcagaagaggcagagatcacctttgataaatagggacaacctacaagctgattctgaatattttttgcacttgggagctgagccagggcgacaagattagtgaatccaggccccagaatgtggcatgacggccactgtgtactctctcaggggtctgtaattgctgttctccctccataacacactctccattggggtggggatggggggaagggctcagtcaatgctcagatgattctaatttcattcattaactcagcctaaatctgcagagtgtctactatgctaagtgacatttcttgtgagatgattcagttatgcatcttcctgaaaagaaagaggaaaaaaagaatgcagagaaaaataataatttaagggactgcttttctatgcaagaagtactaagtatttctgaaacaaacatgtagatatatttgtacttcatttggaatggatcaagtgaaaaaaaagaaatcttttactggtacctgtatcctaattcttcactaagatggatcatatgaaggatatatgactccttgcttgttcccgtgaggccaggcaacaataagatagtaggtctggtgctggcatccatataacacgtactgttatcattatcaaaccagtccagtgaaatctgtcctccatctgcagttttaataagttcactgaaaggaataattcagaagacattactatttacatgttttaagtcatgtcttaattttaattctaaacacatgacattatttgctcatcaaaaaataacatttttccagcattcacgaacacacacccatatctcgatctacatatcattttctttcattagaaggattttatgaagattagtaccatcaagtatttccagcaacctccgtacaaggtcgtatataaaaatgaactgctaattattaagataaatgaatacttactcattactccaaaacatccagcatttaacccttgtttgattgaggtcactcaactaatgcgacagggaagtctgagtaagtaaaatgctgatctaatctctgaccactgctctagctctttggactcaataatgcagtctccttgtatagtatacttcaagattttcttctgaaataatttaaattatttctcacatagtattcatgaacttacagaattttcccaaacaaacagtgcaagttccaggcaacaaaataaactccagaaggatagatgactaagggaaattaataacaggcaccatttaaatctggttcctgataaatcctggaccgtatctttaacacatcaagagctattatcatcaagatcccatttgcctgtcaataggaagtcattttacaccaataaatcgcccaaaacccaaattaagtggcatccttctcaccccacccccccccccagtatctgctacttatcaatgaatgaatgcagatcatcaaaagatctgggtctttctgacagatgtatgacaaactgcgagacagtaatccccaaacacttctctcatcctaaaaataaaccatttacatcaggttggcggttagggcggggaccaggaggcaaatacctgcagctggggtattttcctgcagctgggggtggagccggggacgtaccttccattttcattccctctttctgttctatatacttcctaaagcagattctattaaccaagaactgggaataagcaagcaagcaaacaaacaacctgtgattttgcagaaatgactgaaaacggaaattcacttacttcctgtactgcaccgggggcttcgaagtgatgaaaggtctaagcagggtctgtcctcgaccctcccagcaccagaccgtcgggtagtacgtttctgtaaccacgggacagtggtcttgaaggaagcggctgaaactctcacccccggtcactaactggggtttctgaagggaaaagcagtatcagagaagggcccagagcaaagtttctgccaaccgtaaaccagaaaccggcaaagacttgtcgctcgcgcgcgcgcttcctccgattacaactctttctggagggctgacgcaaaaaattcacagtcacagaggactgaaacgggggtttcgccaatgccccgaggggaaggcgagaatcgcgataagggagtttgtttgtttttaactccgcctcccgggttcaggggattctcctgcctcagcctcccgagtagctgggattgcaggcgtccgccaccacgcccggctaattttttgtaattgtaacggggtttcaccattttggtcaggctggtctcgaactcttgacctcaggtgatccacccgcctcgggctcccaaagtgctgagattacaggcgtgagccaccgtgccctgcccggagtcattttcaaaagcgccacggcgttcccgagtgcgccgccggcttcgcgatcggtgaccgggcagcgccgcagcgcagaagtcagccgggttcaggctgcgctccgaggaccacccggccgggacccccagggggcgggcgaacgggcggggcctgttggctttcccgcgcgcgctgggggctgccgctcgggagcagctcgccgcctatccccggggctgccgaccgcccctggccgcgcagcctcgcgccgcgcctgctaccctagctcctggcccagcagcccgcggccctgcgccacccccggctcaccttggcaatgctgctcaggtagtagaaggcataagcgacgctgaagcccaggataagggataagcccacccccgagccgaagaaccccacccggacttggtgttccaggtagagggagagctcccgggacaacatccgcaggtccatggccaggcgctgcatggcccccgagcgcggcgcgcgggtcctgcggcgggaggagagccggctggcgagcgggcgagagcgggcgagagcggacgcggcgccgctgcctactcccgaccacagtgtctcctgcctggcggagcgcggcttccgac

SEQ ID NO: 1318 - DNA, 201922 bp, Homo sapiens
ttttagtttctaaaaatattgttttattaaataactgttaaataggatttttacaaaataaatggcatagaaaagggtaaaaatgtttatgttcccagaactttctatgccttttcaacagaaaggaaaaggcacagaaagttgtcagctgctattacttctggagagctgccacaactggacggtgttggagtatcaccagttctctctctcatgggaaagaaggggatcaacactttgtagagaggtagcacgtcttcaggtaacagctgctacacacagctggcttcaactttagctcccctgttgatgactgtcagcttcaaggtgtagcatcccatggcactcaggaagaattaaggagctgcacgaggttttcaagacatttcaaataataggcatttagagggtttgcttctgagtttgggaaagctgagatagaaaaataagagtacagaaatactagtttatgaaacttggtactatacttaggaggcacacacataaacaaatacatatgaacaggatttatatataatttaaagctctaagttcttgatgtaatagcattccagaatattttgcattttttaaaaaataaacaagttacaaaatcaatatttttttaaattaacagcttacccagagtattttttaaaaagtaccccccataatggataccattaactataattccaaatgaatgccattaatctttttttatgtaccatccttcctaaagcataatctttaacttcactagctccagaaattcatggtcgcagctaaaacaaactaaaacctcccctgcttaaaaaaaaaaatcagactataaaaacacaaataaccaacagatatattacagtacaggaaagacacaattcagtgttttagcataaaaaatgttcagagaataacgctcactgaaatttggtgtcactaaaaatgaataatgtgctttgaaaagaaaaccgtctctagtattgtgaccacatcacagggaaacgtggatataagggtaacaggatcaattcttggaagactgtcctccagctccctgatgttagatccaggttttctgctcacagttaattctaattgggccagttcttatcactaagaacatacttcagcacagtggtcactgttggcaaagaaaatttagtacaaaaataagacgaagatcacagatgcatttttagaagcaatcacatcttaaaccttcatctatctattttattattttaaaaaatgatataattaaagcacatactgaatattggcacattttacaatgccattttgctgtggcctgtccaaatatctcattaatcagaaaatccacttaatagcttctgagtttaactataatctctttcttattgcaacttacttttctttgctaaggagtatgcttcatccactcttctttttactgatgggcttttcaaagctgtttttgcctagaacaatccattaattaggtttcttgccatgtgttatggatcatgatagcaaaacactaattctgcccattgctaactacagtattaaacagaatattatgaaatataataatataactagagagttccatcttagcataatacatcctattgagccaatccccttgcacattctgaagtcttgcccatatcctcttatctaacttgattctttctctattcccattttctttcttcccttctcttttactccttctcccctaatctcaatttgctattttaaactagtcatccttggtttcagtttttcatactccctcaaacctcagatttctgatcacatataccaaatattagcagttggtcaacaaatatttacagagtgactacaaagtgccaaatcctgtgctaagctctggggatacccaggtgagaaagaaaacaacaccctcttgtccttgtgtacgtgactctggccagcagggagaaaactagccccggcagagacagtcagctgagagaacaccattctaggatggctgtctatcctaacactgtcacttggctactacttaatcactagatacttatgggtatttctcttgggaacaacatgtctgcaataaagtggaagtccaaaggccagagaaagagtagaacacaaatctccacgttgcctgcccttttctcagagcaggctttgggctgcagtcgtacaagaactgagctagataaaggggaattgtacaattggataaaacttttgttactcagttttactttaagatgtgttttcccttgatacgtcttttagaagaaacaatctatactaaaattgcaataataaagtaaatcaatttaaattaagaggaaaaagtcagttcagagattctcttctaaactgagacattctgttgaaatgattaaataaaaagatttcaactgatggtttactaattgtatgaatcagcaaagggaacatggatctttgattttgtcttttttcttttgctgtaactcttgacacctttggatgtatcctaagagtttatacctgggttataccttgttgtttgctccccaggtgtaacaatgatttttaaaactgaccttctgataattgtaaatcagagcccaaagggcagctgctccaatcctctgagcattttgattctcactttccagacaggcagcaagcacagtaatgactttttctaaaaatgaacatatattttttaaaagttcagtcccagacactgcattgtattcttatcttggactagtcagacacccccctcttttcccattagaatgcatacataaagttggtatcactagactatggcaaaaccaatcttttatgccatgtggtatatgggaggacaacctcaaaacattgttttcatgtcaggcatagaagggtcaaagacactgaagctgcttcattttttggccagaattcaagaaaaggcacattcatttaaagaccacaagtgtgtaaaaataagtatacaattaggtacattaatgagttactcaattacagctaacattctggcaggcagaaaaacagatctgctttcatgataaattataaagactatcatacaaacacatcagtagcatgagctactatacaaaaacgatcatcaaatatcacactgcttgatgttttttaaaaatgactagggtggctggcaagatggctcaataggaagctccggtctgcagcttccagtgagatcaatgcagaaggcgggtgatttctgcatttccaactgaggtacccagctcatctcactggagctggttagacaacgggtgcagcccatggagggcgagccaaagcagggtggggtgtcgcctcacccaggaatcacaaggggtgggggagctccctcccttagccaagggaagctctgagaaactgtgccctgaggaacggtgcattccggcccagatactacgcttttcccatggtctttgcaacccacagaccaggagattcccttgggtgcctacaccaccagggcccagggtttcaagcacaaagctgggcagccatttgggcagtcaccgagccagctgcaggagatttttcatacctcagtagtgcctggaatgccagtgagacagagttgttcagtcccctggaaagggggctgaagccagggtgccaagtggcctagctcaacagatcccatacccatggagcccagcaaactaagatccactggcttaaaattctcactgcctgcacagcagtctgaagtcgacctgggatgctcgagcttggtggggagaggggtgtccaccattaatgaggcttaagtagcctgtttcccttcacagtgcaaacgaaggcactgggaagttcaaactgggcagagcccaccacagctcagcaaagacgttgtacccaaactgcctctctagattcctcctctctgggcaggccatctctgaaagaaaggcagcaggcccagtcaggggcttatagataaaactcccatctccctgggacagagcacctgggggaaagggcggctgtgggtgcagcttcagcagacttaaatgttcctgcctgctgtctctgaagagagcagtggacctcccagcacagtgctcgagctctgctaacggacagactgcctcctcaagtgggtccctgacgctcgtgcctcctgactgggagacacctcccaacaggtgttgacagacacatcatacaggagagctctagctggcatctggggggtgccctctgggatgaagcttccagaggaaggagcaggcagcaatctttgctcttctgtagcctctgctggtgatacccaggcaaacaggggcaggagtggacctccagccaactcccaaagacctgcagcagagaggcccgttaggaagaaaactaacaaacagaaaggaatagcatcaacatcaaccaaaaggacatccacacaaaaaccccatccaatggtcaccaacatcaaaaaccaaaggtagataaatccacgaaaatgaggaaaacccagtgcaaaaaggatgaaaattcccaaaaccagaataactcttctcttccaaaggatcacaactcctcaccagcaagggaacaaaattggatggagaatgagtttgacgaagtgacagaagcaggcttcagaaggtgggtaataacaaactcctccaagctaaagaagcatgttctaacccaatgcaaggaagctaagaaccttgataaaaggttacaggaaatgctaactagaataaccagtttaaagaagaacataaatgacctgatgggagctgaaaaacatagcatgagaacttcgtgaagcatacacaagtatcaatagcgaaatcgatcaagcagaagaaaggatgtcagagattgaagatcaacttaacgaaataaagcgtgaagacaagattagagaaaaaaaaaaaagaaaaggaatgaacaaagcatccaagaaatatgggactgtgtgaaaagaagcaacctatgtttgactggtgtacctgagagtgatggggaaaaatggaaccaagttggaaaatactcttcaggatattaaatgcaagagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccaccaagggaagcccatcaggctaacagcagatctctctgcagaaatcctataagccaaaagagactgggggccaatattcaacattcttaaagaatttatcttttctttttttgttggggagggggatgcagtcttgctctgtctcccaggtttggagtgcagtggtgagatctcggctcactgcaacctccgcctaccaggtttaagcaattcttctgtctcggcctcctgagtagctgggacgacaggtgggcaccaccacacctggctaatttttttgtatttttattagagacggggttttaccatatgggccaggctggtctcagactctggatctcatggtccgcccaccttggcctcccaaaaggctgggattacaggtgagagccactgcgtatggcccaagaaaataattttcaacccagaaattcatatccagccatactaagcttcataagtgaaaaataaataaaatcctttacagaaaagcaaatgctgagagattttgtcaccagcagccctaccttacaagagctcctgaaggaagcactaaatatggaaaggaaaaacctgtaccagccactgcaaaaacatatcaaattgtaaagaacattgacactatgaagaaactgcatcaactaatgggcaaaacaaccagctagcatcataatgacaggatcaaattcacatgtaacaatattaaccttaaatgtaaacgggctaaatgccacaattaaaagacacagactggcaaattggatgaagcgtcaagacccatcggtgtgctgtattcaggagacccatctcgtgcaaagacacacataggctcaaaataaagggatggaggaagatttactaagcaaatggcaagcaggggagaaaaaaaaagcagaggtggcaatcttagcctctgataaaaaagactttaaaccaacaaagatcaaaaaagaaaaagaagggcattacataatgataaagggatcaatgcaacaaatagaactaactatcctaaatatatatgcacccaatacaggagcacccagattcataaagcaagttcttagagacctacaaagagacttagactcgcacacaataatcatgggagacttcaacaccccactgtcaatattagacacatcaacaagacagaaaattaacaaggatattcaggacttgaactcaactctgagccaagtggacctaacagacatctacagaacactccaccccaaatcaacagagtatacattcttctcagcaccacatcgcacttattctaaaactgaccacatacttggaagtaaaacactcctcagcaaatgccaaagacctgaaatcataacaaacagtctctcacagcacaatgcaatcaaattagaactcaggattaagaaactcactcaaaaccacacaactacatggaaactgaacaacttgctcctgaatgactactgagtaaataacacaattaaggcagaaataaattagttctttgaaaccaaagagagcaaagacacaatataccagaatctctgggacacagctaaagcagtgtttagagggaaatttatagcacaaaatgctcacaggtgaaagggggaaagatctaaaatcaacaccctaacatcacaattaaaagaactagagaagcaacagcaaacaaattcaaaagcttacagaagacaagaaataactaagatcagagcagaactgaaggagagagagacacgaaaaacccttcaaaaaatcaatgaatcccggagctggtttttggaaaagattaacaaaatagatagaccactagcctgactaataaagaagaaaagagagaagaatcaaatagacacaataaaaaatgataaaggggagatcagcactgatcccacagaaatccaaactaccatcagagaatattataaacacctctatgcaaataaactagaaaatctagaagaaatggatgaattcctggacacatacaccctcccaagactaaactaggaagaagtcgaatccctgaatagatcaataacaagttctgaaattgaggcagtaattaatagcctaccaaccaaaaaaagcccgggaccagatgaattcacagccgaattctaccaggcatacaaagtggagctggtaccattccttctgaaactattccaatcaatagaaaaagagggaatcctctctaactcattttatgaggccagcatcatcctgatacaaaaacctggcagagacacacacaaaaaaaggaaatttcaggccaatatccccgatgaacatcgatgcaaaaatcctcaataaaatactggcaaactgaatccagcagcacgtcaaaaagcttattcaccaagatcaagtccgtttcatccctgggatgcaaggctggttcaacatacacaaatcaataaaagtaatctatcacataaacagagccaacgacaaaaaccacatgattatctcaacagatgcagaaaggccttcaaaaaaattcaacaccctttcatgctaaaaactctcaataaactaggtattgatgcaacatatctcaaaataataagagctatttatgacaaacccacagccaatatcacactgaatgggcaaaagctggaaacattccctttgaaaactggcacaagacaaggatgccatttcttaccactcctgttcaacacagtattggaacttctggccagggcaatcaggcaagataaataaataagggtactaaaataggaaaaggttcaaggcagggtctgtgagtgtagcatctgctcactggtactggttagagggcagtgtctgctcactggtattggttagagggcagcgtctgctcactggtgttagatagagggtagcgtctgctcctggtattggttagaaggcagcgtctgctcactggtattggttacagggcagcgtctgctcactggtattggttagagggcagcgtctgctcactggtattggttacagggcagcgtctgctcactggtattggttacagggcagcgtctgctcactggtattggttacagggcagcatctgctcactggtattggttacagggcagcgtctgctcactggtgttagacagagggcagcgtctgctcactggtattggttagagggcagggtctgctcactggtattggttagagggcagcatctgctcactggtattagttacagcacagtgtctgttcactggtactggttagagggcagcatctgctcactggtattagttacagggcagcgtctgctcactggtactggttagaaggcagtgtctgctcactggtattggttagagggcagcgtctgctcactggtgttagatagagggcagcgtctgctcctggtattggttagagggcagcgtctgctcactggtattggttacagggcagcatctgctcactggtattggttacagggcagtgtctgctcactggtattggttacagggcagcgtctgctcactggtgttagatagagggcagcgtctgctcactggtattggttagagggcagcgtctgctcactggtattggttagagggcagcatctgctcactggtattagttacagcacagtgtctgctcactggtactggttagagggcagcgtctgctcactggtattagttacagggcagcgtctgctcactggtactggttagaaggcagtgtctgctcactggtattagttacagggcaacgtctgctcactggtattagttagatggcagtgtctactcactggtattagaccaaccacaatgctagtgtattttaggagctcaataaatattcgttgtgtgaaagattccagaatagaataaacaaaaattttgtctacataattcaatttttttattttaagggattttaaatatttaacaaaaacaaaacaaaaaaagctgctccctaaagtgaactggaaatgtgcatcaggacaatgtgaaaggcaggtgcagtgatgtttcgggcacgctgcagccgactccctgaacacctcatctgcactatctgatgccctttggttgtcgtgtatcataacctacccagaaccaagccatgtacatagcttgcagatgcaatttatcacgtgaggttatggctgcaagtgctactcattagggcacatcaaatgtccccttattaaatgggagggtgacttccttatgttccatctgagtagcatcaagtgatgtttttaaatgttgtctcaaacactcagaatatataactcctctgatctaagtaagtttataactccttcaaccagctatcccttaaagcatttttaataaagtactgtgtgtgtatgtatatatacatatgtgtgtgtgtgtgtgtgtctgtgtgtgtgtgtgtgtgtgtgaattaatgtggtgggcccctctgataatgcaagtggatcgacttttttaacaaaacaaatgttattgtgaaacatgcatataacaaagcaataaaacaattttgagttcaacaagtaggtctgaactctcatataaacatttaaataacctaaagtgaatatacagtagtaaaatgtaaataatgagacagtatttttgaatatttgaactgaatattaccttaatataataattgaatgttaccttaatataataattgaatattaccttcttaatacaattggtttaagtataagtttagggatgtcagtttggtaattacagtgagttgtcagttatggtgacattaatgtcttagaaaagttcttaaagtttttacccatcatttcttcaaatatttcctctcccattctcctaggacacttcattaaacacaaagactgtcttgatatatctgctgtgtcacttacctttgattcttttgatcctttctcatctttttagctttctctgctgcattctggataatatttttctaatctatcttctaattcctaagttctctgctatacctaacttgctgtcagacatgtatattaagttttcaattttggccactgaagttctagattactgttgtaaaacagaacttcctacaataatggaaatatttatatcttgctatttaataagatagccactagccacatgtagtgagtacaactgaataattttaattagtttaaatttaaatagctacatgtggctgattatcatactgcacagtaaagttcttgaagttctgtttggttcttttcaaatatttcaacttgtcagtttcccatttcctaaaattttcaagcttgtcatttatttatctaaatatggtataattaaagttatttttaaacccatgctttgtaattcccatattcaaagtctgggcagataagctggtatttttattcttctgctgtttcttactacatgttgccatgtctcctaatgtgcttgattatctctaactttgtactggttaatgcttttgaaaaattatttgtagaggttccctgaggcccagtatgaacttgtctttcatccatcaccaaggcagtttgctttctgctaagtacccacaggcaccatcaatcgaagacacctcaagccaagttcacggccaactttgggtgcagagccctatcagaagcagtctgtagtacccattctcacattttttttttccttttctttacagtctccttcatgaagtttgggaaaccaacttatttttgacccatccatctattaagagaatggttctttggaggtccagcttaatacaagcaggatagccagtaagaatccccactttggggaatcgcggcttctgtcctctcacccctcgatactcctcaacaaaagccaagcatacaaccttggcaaatgcacttggggcaaaataattttctatatacttcttacttgtctgggcaagactttcaatcaaaactggactgggagtttctatcttttcagtttttgtgattattttgaggtgcattttaatacagcctgtctagcatgttattgtcgttttcagaagagacttagtctggcattgccagaaacaaggaatgttccagatctttttttttttttggagatgaagtctcactctgttgcccaggctggagtgcagtggcgcgatcttggctcactgcaacctccgtctccccagttcaagcaattctactactggggactacaaggtgcccgccaccatgcctggctaatttttgtatttttagtagaggcggggtttcaccatgttggccagactgatctcaaactcttgacctcaaatgatccacccaccacggtctcccaaagtactgggattacagttgtgagccaccatgccaagccccagatctatttttaccagcaaggtcaagctccactgcacactccactcctgaccatttaaaccagatgtgtgggtgctaccgatcagaggcagcctttcctgggagacttttaagctggctgactctgctaaggcctcctccataaatccccaagtggaaagcgaggcataggctgtgacatccctttatagttccacacagaaactgcacagctgatgtctcttatcttacccctgcctgaaaagcccactgatctctagtctgtgggctaggggaagcttctcaccaaagtttatccatctgctttaagctaatgaaggagaaaaagcattgctgactacaaagaaatgctaaaaataattctagaggggtctagaagtggaaaatgcagacttctctccttcacttctcaaaaagcttgacctttttccaactctcaataataaactggagtaagtagccctcaaagaaaaaaaaaatcattctaagaaaggtgaataaacaataacagatgttactgagtagctgctatataccaagaatggtcacaaacacttcacaggctctctcattgccctgaggagggattatcatcaccctcattttacaaatgtgagggctgaagcagctacagtgggagaggatggaaataaaaccagtgatgtacatcacgcagcaacagagaacgcagcatcagcacagcagccaccggaaggcagagtgcaaaatccacagtaaggttaggtctgctacaagctaactgaactttaaacatccttctatatcatatctagcagttgattatcagaatgcttatcagaaaaatagaatcacaactatatacaccacaaaatataagaagaatcattttcgtacacttagaaaacccttgatttcacagaaaaatgcttctgagaaaagtttaagtgaaaaacatgaaaaaaacaagagaatgaatctatcttaaacatttatcatgtaccagaaatagcgctaggcactttatgtgtgtttataaactgattcttaccaaaccaagaagagtgggcttcttttatagatgaagaagctgggcccagcgaggctgcaccaggcgacgctggagtgatgccctagtgctggcattcaagaccaggtgtgtaggggtctggagcccaccttctgtttttcactagaacacatgtcttttataaaactcactccccacgaaattcacatactcctcacagagataacacatggttgcagaaaaagatctttccgattctttttgcttcaatttttttctgaatccttaccaatcctcgcctccatctgtcctacatctcagagaatgaagtctctgcgaggctcactgcaccatctgatctcaagccctgaactctctccggtctgcttgggatctctctcaatcatcaaatatttattgagtgctcgctagttgcaggcacaattctaggtgctacacataaacaaagcagacaaaagcctcctgaccccataagagcttaccttctagtgtgggaagactaggaatagacagatacatgaaacacataatctatcagatggcgataatactacggagggaaacaaaaccaggaaaggaaatagtgaggaggaggaaagagaaggccccctgggtgcggggctattatattaacacatggttcccgagaggcttcattgacatagtagcatttgcttgaagatgcagaagaggggagctggagttagaggaagagcaaggagagaggagagggagcagaaggtaaggccagggagccctcgtccacggctccccttcctccaggtgtccagtatgtgcactggaatgacatgatttgctaacctcaggagactcctggaagcccacggaaggctgaagccatgcctgattcattcccatgccttccacagtgctttgaacacagtgggtgcttaataaatgcctagaaaattatttataaaattatttggtgttgacctgaacagtctatgaataactacatatataaatgtatgtgtgtgtgaaaacttaccattagccaggatcttgggtttatttgcaggactgaagcaaacattatgaaagataagaagaggcaataaagggctgctcttgtgcttgtatttgctcatctctgttagtaagtctagacagccatcaagcctcagaatcatttgttgcccatcttctccagatgatatattcaggagtaacttcaaccaaagaatagtcagattacttagatgtttatttcctccttttggcaatgctagagagaggaagttctgtaagaagttactctgtggataaatagagagaatattattttcttctcatctttttcattattttcctagtcccttggtgaccaattaactaacattctgatatactctccctctacattaatttctcctttctaatagcttctgaatattccatctatattatttccaagcataagtgaaaaaggtaagaagaacaaaatagtgctcaagttttaattcctgctaattatttcctcatgatggatgaagtatactatagttaactcttaattatttagaattggtaattaagtttggagattatttcagggctcttgagttttctcttctctctgccttctggtgattttgctattaaaagctaccctatggaaggaaaaaaggcaaaaatccaaatcagtcttgaatactagttaacaactctggaagtagtgagggtattttgaatcattatagctacaggtgttgttgttgtttttatcaaatctatagatacatcttacattcactttatcccaggtacttatcattacaagtaagaatttctgatggctacacgtcattctattatgcttacagatgagaaagctctattatttgaactgtaagagtcttttcaacctccaaataaagccccttccaaaaaaccccaccaaacccttcactataagaaagataataaattattgcttagactaatctatatgcaaagtataaaagtgctgcatcaagctgcagcccatggcagcatggaaaccacagttaggtggacattttagaaatgaaatgcaatcacttaacttttatgattgcacagaataactcttctctctctctgtttaaatctactccagtttatctcttaggttttcctagaccaaaatcaagatgttggctttaatctataaaataaacttaacgtttttatacaaaaggactctgagtgttaagaatgaaatgagctacagaaatattatcaacattacccacacaataagtaaactgtaaaattacatgcccactttcagctgcatgtgctgtcactcacacctactgtcagccaaactgacagtttttagattcaacccttgctggatttgggactgacaagggtgataaagcagatgtcagtgctctcaaatataaatgtgctgtgggcactccttttttttttttttttttttttttttgctgcttctaaagatgttttcagacaatttcctacaccaggtagaatatgtagagatgtataccatggtagaaaaaaaaacaaacaagcaggatatttcggagcctgagttgtacaataccacctgctgcattttctatgtcctacagatgagtaatgaagaagtagaagtgttaagtgtctgggctcattattacttaatgcagcagaggaagtctcaggcatttcctaattagagcagaggaaaaagacttgattaatccgtccctggaaagagagtctgatcacacttcatcaaaatattcttaagtatagcaccagaataacagattaagagttgaacatatcttagagattattttgttaaacccaaatgaagctgaaagagaataggtctccagctcaaagtcacagaccagactcgagattggcacttacattccttctgggtgctcccacttagcttcccaccaacatgctctataaggaagtggtggaaagcactgcccccgctctgctctcacatatgcagaatctctcattcttatggatgctaatcacatatatccagttcaagagaatgtctcattttggaagtgatgcatgtatatgaatacatatatgaagaaaatatattcaaatatatatacatatatgacatacatgaacatatacatgaagaaaatatccagccatgtgctggtaaataaacaactgattgtggtgagggtagaaaagatccaagatttgtacagttcgctgaattacgtggtgtgatatgcccactgtggctgatttcaaaataacaatgtaacatcaactggaatttttataaaattcctgcaaatttaagatgacactcatgagtcagtaggaggctggctccaacgtgccactgaaaacatctttccttggtaagattgatctttccatttccttagaaagaccgaactttctatttatgtggtgataacaaagtatcttctgaggagttcagggagaagaaacagtagaggaaaaggagactcaattcttataaatgctctcaacttctgcaatttatcttggccttcaagtaaaagaaatggaaacactcaaattacaatactagtaagtagtatataatctgattacattcaaatttgaagggattttcccaattagggattctgtttatacacatctaaatacagaatataagtgcacatgtgtactagaatttatttaactcattacatcccttttaaattaccttaagttaaaatcagtgatgagaagtctagattgggaactggaatcctagagaactcataaaattgcttaacatgccataaggaagttaagtctaactgggggaagtgggctgtgatttcataaaccattttgtcaatgaaattaaactgaaattgttactgcccaatttggtctgtttaaagaccaatatattacttttattatttccaataaatgtaagacggctatctttctaaaaccctcatctttgagaatgataaaatacaatccgaaagctaagaagataaatgagaaggaaatggtatgactctactctagctcctgtccttctgcacgtgtcatctatcaactggctttaaacaaagtgaacctcttaacccttttataatcctttaaaataaaatgcctcaaaatcataataatcttagaaattgagttgtaaacttttgattggaaagattatttcactgagtacccttttaagatatgtggggagtttaagtgcgtaccttctgaattactcctttacagtcatgcgacaaggccaggtttgaaagaagcataaaaaccatctgctgaaccgtggtgttctccagtggcatctgggaagccaactttaggatacacagcatcagagagttgctcacggctcctctatgtgtagcttgaacagggtgttgtccacaacttgaccaacaaagagaactgcaaccttcaaaaataacagcctatcacaatgtcttctcagtttccctgtttagtttttgaagacactaagtggcaaagcatatctgtctaacaaaatgactaggccattaacctgtgaactgcaaattagcaatggaggctaatgttggtgtctacagtcaacctaatagatatactgtcctcactgagggcctaattatctcactaaagcactttaagacaccaggtttatttttaaaaaaagaataaaataaacatactagggtttttaatagttgctaaagaaaacatctaaataaaggcctgtgtaaaggaacagaattttagaaatgggagataacttgtctaatgccttcattttacataacatacaaataaggaacataatatccctgggaaagcggacaaaacaaatactattttctatatttggtcaacaaagatatggagctcagaaaagccagtttgttgttcaaggtcatacagcttagcatagcaggagccaaaagtggcatctacaggctttccagggttcagtgtttctcaggaaattaagtaactgaatgagacttattgagggagaaaaaaaaattagaaatatattttaatgttaaatcaataagactgtattatacataaacctaaggtataattgacttgtgaaagttcatacgaggaggccaacttaagtataaactgatcagaatcaaatacattctgtaaaagaaactcataaaagatgagtaaacaaacaaaagatatactagtggagctggaaaatgcactgaaaggagacattcccaccagacctaaggaatggagaaagttaacagcacagaatgaaggcaaggacaatcctgtacacatatgcttcaatgacagttcaagttcaagagcttgaaggtctgtttatatctctttgtgctgactggagacaacctgagttgggtatcgaaatggacagctccagaggtgtcagattattcaaaggaataagccatcatcagcatctggcagattattcaaaggaataagccatcaacagcatctggcagtaactagatgggctccttaactgttgtgagttccagtcccttctctgtataacctttgatattcagagaccccagttgctgggctactgagtgttgttagaagaaagtacaaaaacttgctagtcaaatcttaaatttatgaccataaatttaataaaatttaaatcttaaatttatgaccataaattatgaccataaattctaatttattttcttaaatttatgaccataagtggtacttaacactgccagcaatcctactttgcttctctggtgtgtttactttccttcctctaaaaacagctacttcacactttctcctcttctcacatcacctctactccttgtctttgctcattcttagtggtcagtgttctctcctaaatgaagaaagcagaagtattcaaaatgggaattttctcatcattcccatcaagtctaccagccctcctaaatccacatccttcctctcagccttccctccgcttctgttgtcagctgtgctctagctctcacctctcttaccctctcaggctgggctcttacctgcactctttcctgcacctcattctcccaatcccttaagttaataaacatgccttaaaaacatacatctttaaaaacgagcaaaaactcctcctttgactccacatctgtctcttgctgttgctccatttctttgtcctcttaagagtagtacattttggaaaagctgtctcctctacttcttcatcttctctcctcagctcacactaagtaggtttctgttctggcactgcactaaaattaccctcaaggtccaaaagaacatcaatactgctaagtccaacagccattttttctatcctcactttagcagaattttcaatagcattccacacaactgagcatgcccttctctgactttctgtgactgtgcactgttatctcattggctgctccttctcttttttttctgctggtttctcatcttttgattaactccaaatgttgatgtgcctcagaacttggtcatgggtttctgcttctccatctacacattctccctgggtaatcgcaaacagccacgtggctttaagtacaatctacatgacaatgactcctgtggtagccagcctccaagatggtcccagtggcgcctgcctctgtaccagggttggtatgtgtgacccacaagagctaggagtgctgttcagttacttctgagactggattataagagactataacttctgccctcagcccactcattctgggtcgtttgagacagccctaagtagcaaggaattgaggctcccatagtcacactggatcctctatcccagtcaagacttcagatgattgcagagactctgagcgaggaccacccagattagccacgcccagattcctgagccacagaagccgtggcataatgaaatgattaatgtttgcagatgctaaattttagagtaatttcttttgtagcaataaataactaataatattcccaacatttgaaatcttcaaacttatctctacactccattgaattcaactccagcttactattttcacttgagtgaacatcaacaccttagacttaacaagaccaaacagaactcttgattcctactactttctcacttcaagtctgcttcttttaaatcttccccattttagtaaatggcactactgtgcactcaggctcatttctccaaatgaagttcaccccggacacctttttttccttcctacctcccacaacaggtatccttgactctacctttgagctatatactgaatctgtctacttctctcaatctctccagctaccactcaagcccaagccaccattatatctccatgacaagtctccctgcttctagacttgctcccaatcattcattctccacataccacccagggcaatttttcttttcttttctttgtgagacagagtctcactctgttgcccaggctggagtatagtggcgtgatctcggctcactgtaacctccgcttcctgggttcaagtgattctcctgcttcagcctcctgagtagctggaactacaggcatgcaccatcatgcctggctaatttttgtgtttttagtagagacagggtttcctcatgtttgccaggctagtctcaaactccagacttcaagtgatccgcctgcctgggtctcccaaagtgctggcattacaggcatgagccactgcacccagcctaatccttcttaaacacaaattaaatcatgccactcaccagcttacaactgccaatgtcatcctgttacactcacataaaaatccaaactccctactctggcctctgaggccctacatgacctgtcctcctatctcatttcagatcactctcaccagaactcacaatgcatggcccaccacaggctcttgataaagtgtctatcaagtgcatgagcgaaagaggagccctagtgatatcaagtatcaccagaccaactgttatgagaactttcaacatgccagtctcctgctctagaatctatgagaagttctaaccttcacgtggcttttgaggtcttacatcataatttttatcctctcaattttcctactaaactcaatttcccattgccagataatcagaccagtcctccctctctattccctgcgctgccaatgactctctcatgtcaacaaacacactaaaatatctgtctgctctcataatacctacgagaaagcttgcctttgcccatcatatcctcaataaatcagagaaatacttcaaaatatgtattagtttttccagtccaccttaacaacatttataaaactagtattttggtatattattgaaaggcagtattggatcctattaccatttggaaaatttgcagtatagacacaaaggagctgcagagaaatttgcatcaatgaatcatccatcaaaatccaaggccagagagagtgcaagacagggacaaggtgagcttcaagagctgcttcctgttgaaggaagggaaaaagacagcattagtctgaatatatgaaaatataacattaaaatcaaaacaacaacagaaagccatcaacataagacccaaggagaaccctgtggatggcttcagcatcctgccccagccccattgggctccacacatggctgccctgaccacgagcctgaccaatctcaggacgtcgcttcaacaccagggtggttaagatgtaccactaagttaggaagcatagaaaatagcctgtgtaacatgtaaattaaacagcaaagtgatatctcacaacactgaataaattcctgtaaatgctatgaactggccaagaagtgagaatttctggttaagtaaacattctgatcaactctgagtcctctttgcccaccctctctccctctccttctctctctctgtgtatgtgtgtatatactcaaagtaaattacagtttttgagtaatttgaatatataaaattcagtctaaatattatgataaattgaaaaattctgaagtaactcagagtctttattacaaagatcagttaccctgggacaatattgcagataaaatatagctgtttaagtgcagcaatatctattttaaatgaacaagaattccgaggtaatttgtagacccatgattatgcacgtgagcatgcacataaatacacacaccctatacgatttcacatagcatcaagtggcagaagagaagtgattcccaatgttcaacactctccgtaagcactgaagtcattcccagtgctctccctaaagttcttcccttgttcaccactctctgtggcacacggccctccatctgcagcagatgaccttgtttactatttcacagagaagacagaaacgattaagtacaaactcctttatctactctgccattctgtccacatagtttatctgtattttcatccattcatccttcctgtctgcccggtagtgacaaagaggtgttccacttcttgcctgccagagattgatacatccatctgtgttctgaaacacagctcttcctgcctcctcagggatcttaatccaccagttagttctcctcttgctatctcttaaacaactcgtccccaatttgctcatttctgtgcctgtattcaagtagtttacgtgttaagagaaacaaacatactcatttcctttcatcttatatgtcctaaattattaatgccactattcatgaccaaacttctacattattattgctgtaatttccctgcctcacatttaatctttagctcattaccgtttattttctgccctgatgattctattgaggccgcttctacttttgtggttgccaacaacgcttaagcacggtggcatttgctatatgtctcttaatttccccgctgctgctctatcctggatcatttctgataagagtctggatatttgtccctgcccaaatctcatgttgaattgtaatccccagtgctagaggtgaggcctggtgggaggtgtttatatcttgggggcggattcctcatggcttggtgctttcctcaagacagtgagtgatctcatgagatctggtcatttaaaagtgtgtggtacctcctcgccagctctctcactcttgctccagttctagtaatgtgatgtgcctgttccccttttgccttcttgtcatgattggaagtttcctgaggcctccccagaagcagacgccactgtgcttcctctataccctgcagaactgtgagccaattaaacctcttttctttaataaattacctagtctcagatatttcttcatagcaaggcaagaacggcctaatgcaatctccaaattccttctccagtattcccttctcagttgttttctgccccctcttaaatgttcctgttttccaaagatatgaccttggttttcattacatactttcttgggaaatttcaacaatagtgaggaccacaaacaccatctacacattgataactcctaatatccccagcttgtatcactccttagagtcccagacccataaaatctacaggccacaagccatttttcacctggatgccccaaagactcttgaggctagcacgtgcaagcatgaatatcgggtctctcacacctgtgctctgctctatcatgcactcttaatgcatgataatgcagtggcttaaactggagtttggaagtcattctacattcctcctcttctcaatgcctcaaatttactccctaccctccttctcctttctacctgctcaagttaaggtgtcatcatctcttgtctggactatgacagtcccctccgtctaaccttgtccactgtttaattcatttacctcacagccaccatgctccttccagtatgaaaacccctaatgttatgcatatgcaaacagcagggtggggtggcagtgggtgacctggtgaattacccaatagtggccaactattaataatgagaacatgccatacacctgataaaagctgaaattgaaattaacaatccctacctccataatattatatttatactcaaggataatcttaatattctttggatttacttcttattaaacaacttagaaatacagaaatgctttgacttattgagatatcacacttttgtaaatggctaatgtgatacaaattgagcacaatatttataactagtagccaggttagcacttcataaatctttataggtagatcccacatgtaaagtattccagagtatttccctgaataaggtgtcatgaatgaatattaactgcacatacacatgaaatttatatatttaaatttacacacaaatactgactgtacatccagtcacaagcataatatcataagcatgaaggaatcattaagtttattaatggcacttttgtcttgagaaaaagttcatataaattcatatatagggaattttaataaattgtataaataaatacttaatttccatcaaactactttgaaatataaattgtgagtcatgtatctggctttttaacatcgcttaaggagtaagtgtgttcaacatgtccattttccagatgtggtatggtttttccagttgtgctcttaccacaagtaagagcaaaacaggtaaaaatttataaggcaataaaagcttccataatttatctttgctttctatattaaagctttaatttagtattttttaaaatttttattttcgtggccagcttttataaagaataatctagtatttctgcattaaagcatcaatctagtatttcaaaagtgttgtaaaactatagacaaagcaaatcagagtgttcacaagattatatcctctatagtagtactgatacaatggtttaaaacatcatcagtgcttacagacgaagcaaaacatctcagtgatttttagacagaagggccatgtaaatggtcacagggagtcagcagagctagaagaaacttcctctcggtggatgtggccacactaggtagcagctctaactatcttctcctttgaagcaggaaactcttcattttctttccttatagatacagatagcttcacttatttccttgaagagttgttttgacaacccgttttgaaagaatctaccttataaaacacatccagccattcattccatatgtaaaacatttaaaatacctaagagtacagaatgaggctgaagtttgcgaagaaatgtaatcagtgtcgatgaataatgattagatacacacatttctgacaattaacactgagtttaaggaccaatcaactgtgtgtctaaaaatttaaaagtcagagctttccatttttcctactacattatctcacataaaaattaaactgcttaataccagtactcctattaaaattttgaaaagtagttctacttactttacattcctcattttgataaagacagtttcttaggagctgcatggcaatgcttaactctttaataacaccatcctcctatttaaacaaaaagcagttgaaaactgtgaatgcaacagcatacttcactttttgtgtatagtaattccctcccctttgggtcacgggacaatgcaggtgtgctctaatcatgcccaaccactgtaactttgagggaactgacaggctaacgatctctgaaagatgaccatatctcaagaagcacattcaccatgaaaaagctatttctgttctatcaagcatggaggaactcggatatatgatagcctccatgtttcatctcaataaagtgaggcagatactgagagattttcaataatatcaggtgttggctgactttctcaatgatgaagggcctttggctagggaggaaaagaggcaaaaaaaaaaaaaaaaagaactgataaacatacaatcaatctcctgcatcaattacattattaaataagactttgtcttggtttcttaaatgcagtagaaactagttattacatagagtgctgctataacggccttacctacacacatatatgtatatttatatatttatactattcacacactttcatttgttgaataagtgggtggcagatcttgttaaccacagtagttattatataactatgttattttcagtttacctgagcatgcagtttaaacatgagtccagcagattcaatgctagaggagatattcagaaggcacaggaggagataaacagagatgaggaataccagctctgcaaccacccagatttggggcaaatattagctccatcaattaccagttgtgtgactatgctgtaatgagtgtttgttcatgagataataaatatgaaatgtttcaatagtggctgacatatagaaaactcttaataaattatagttgttacagatctcattcctagttaacctatgcttgttttgagataaagattttctttttgtagtataaaaaatttatctggcatagtatcatgtatatgtggatatttccaatgtttataataacaacagtacataatagacagatgttgtctaaagatcttcaagtaagaattaagaccaaaaaaagccaacaatctgctaatgtagaagtctcattaatttatccatctgtacctttcttctaaatgagacactcatttcaagctcgtgctcatttctaggcacaagaggactggagaatggtctctatatatagccattcatttatcccagaatgttaccttttttttcaatgctgctttcccaggcctcagagaatctaggttcagttgtgcatttatgtgtttcatctgctccatgcaattgtctataagattggctgaaagacaaaatctgcagtagtcaaaaggatattctatttccaagtaagttataaccacatataccaatcagattctcaaaaaggtaacattttctatttctgacccacttcattttagaattttcagtcagagattaatgaatcagaggggggataagtaagagaactaaaatgctgaagtccacttgttttcagtttttagtaagatactacccaaatccaatttacaacttgaggaatacatcatttgttgtagtcgcaaatcacaattgatattaatggacttgatgttgccattattctcttttaattctcagatctacattctccgattcccaaatgagaaattacaacactcaagagggaaatttatacgaaaatatggaatcatctgttgctgtttttaccatcaaaactatgtgggttttgttcaggtatgcagtgagtgcttctggatagtaatatttaattataatgaaactcaatgtgttaccttttagcttccctaatatttacatataggttctttagagcaagaaccatcacatattaaacaaacaaaaacaaactatgtctaatctttttatttgaaaagtaatgcatatttactgcttctgtatgggaaaaaaaattatttttagtgacactgagattatactatacgttttttacattttgagtccaaagaaaattaacttgaacaagcaacaaaacatatgaattgataatgccatcaaaacagctgatgtgtcatgtggctcacctttcaaagcatgtttctgtgctcttctactgacagccagcagtgacatcaatgcatttgcagctactcttttcaggatatctttggaggatttcccttcatagcactgcagagaatataaatcaaactgccttgaagaaatatttaatctggagcaaaactgttgtgaataaagaacattttctacttaaaagatattgctaggtttcaactatcatgtgaaattcactggattttgataaatcattaatatttgagaatgttctgcgtggataagactgtataagttgcttataatatggaaaagaacaacaatcattcttaaagactcatcatctacagaaaaaagctttatttagctttcacgtagcaagctcatatacttactcaaattcaccagcgcatattgtatatatatgtgtgtaccttattaaaatgggtccttgtaaaactgctgaacaggagaactgtcatcaatttcctcctttctccttctggggacacattcccctctctccatttctatctaaactacccctatatctcaggtgatttggttctttccatctttcgtttctatggtaacatgcacctgtcatataacattttctcaaaaaatagtgtgtaacttttttgactttcagagaaatggaaaatcatttgtaattccgaaactactatttctgtatatttcctttatacatttaaatttatgagctagaaaaattttcacttaaaaatttctaatatgtacaaaagcagacacaataacagattccatacatttttattaaaaatcaaaactagaaatttctgctccaagatggccaactagatacagccaggaggaacatctcccactgagggactgggacaccaggaagactggcacactcctagcagatcttcagagggagggcatcgagagcagatggagggaaaacacagagctggggctgaagggggaggaagctggggaccctgctcggggctaccaagcaccacaacttgttcctggcccccaacaactcctgcagagggggaagttgaaaaggcaaggaacaaaattcgctctccccacaggccgctggaatcctggtaggaaggaacccctggaccaccatggacatttgagttgtcagggaaagctgcttagggaagcagtggaagcagaactccagctggggcagagcccagagagtttggtatgggagtgtctatagcggagcatggccaaggatgcccatccccttaggctagacttgctcccataggagactttatccctaggggaactgtgggacctcaactctgcagggtggtcttgcccatgagatggggccaatctggtccaccctttggtctgctggcttctcccagagcccgagcctagccacacctgcttggagtgaagctcccaggtacgggcccatacggtagctcctgcactggcagactgcctgactagcagagtgctctagcagagtgaccccagtggacacgcaccagcattcttcccccactgcagcctccttcatgccgccttgcctgcaggcactcacccatctcatgcaatgacacacataggctcaaaataaagggatggaaaaaggctaccaagcaatgaaaaacagaaaaaagcagggattgcaattctaatttcagacaaaatagactttaaaccaacaaagataaaaaagacaaagaagggcattacaaatagtaaaggactcaattcaacaaggcaacctagctatcctaaatatatatgcactaaacacagaaacatccagattcataaagcaagttcttaagagatcttcaaagagatttagactcccatagggtaacgtgggagacttcaacaccccattgacagtattagacagataatccaggcaaaaaattaacaaagatattcaagacctgaactcaacactggaccaaatggatctgatagacatctacagaactccccaccagaatacaacagagtatacattcttctcattgccacatggcacatactctaaaatcaaccacacaatcagacacaaaacaaatttccgcaaattcaaaaaaatcaaaattgtactgatatggtttggatctgtgtccccacccaaatctcatgttcaactgtagtccccaatgttgggaactggatcattggggtagatccttcatgaatggtttagcaccgtccctttggttctgttcctgtaacagagttctcgtgagatctggttgtttaaaagtgtgtggcatcttgcccctctctcttcctcctgctcccaccatgtgagatgcctcgctcccccttctgccataattgaaagtttcctgaggccttcccagaagctgagtagatgccagcactatgcttccttacagcctgtggaaccatgagccaattaaacctcttttctttataaattactccgtgtcaggtatttctttacagcaatgtaagaatggtctaatacatataccatccacactctcagaccacagcacaataaaaacagaattcaatacaaagaaaattgcacaaaaccattcatttacattgaaattaagcatcctgctcctgaataacttttgggcaaataatgaaattaaggcagaaatcagtaagttctttgaaactaatgagaacaatgataacataccagaatctctgggacacagctaaggcagtgttaacaggaaaattttgagcgctaaatgcccatattgaaaagttaggaagatctcaagtttgcacctaacatcacaactaaaagaactagagaagaaagagcaaaccaaccccaaagctagtagaacacaagaaataatcagaatcagagctaaaggagactgagacatgaaaaaccattcaaaagaccaatgaagtgaggagccagttttttgaaaaaaataataaaatatatggaccactaggctagattaatgaagaaacgagaaaagatccaaataaacataatgagaaatgacaaaggggatattaccactgaccccagagaaataaacatcagagacgattataaacacttctatgcacacaaactaaaaatctagaagtggatgaattcctggccacatatatcctcccaagactgaaccaggaagaaactgaatccctgaacagaccaacaatgagctctaaaatggaatcagaaataaatagcctgcacaccataaaagccatggatcagatggattgacagccaaattctaccagatctataaagaagagctgataccattcttacagacactgttccccaaaaaaatgagaagtaggaactcctcctcaattcattctatgaggctagcatcatcctgacccaaaactggcagagacacaacaacaaaaaaaagggtcaatatccttgatgaacagcaatgcaaaaaccctcaacaacatactagcaaactgaatccagcagcacatcaaaaagctaatccactacgaacaagaaggctttatccctaggatgcaaggttggttcaacatacgtgcaaacaaataaacatgattcatcacataaacagaactagaaacaaaaataacacgattatctcaacagaggctttcagtaaaattcaacatcttttcatattaaaaactcctaacaaattaggtattgaagtaacatatattaaaataacgagagccatctatgacaaacctgctgtctacatcatactgaatgggcaaaagctagaagcaatccccttgaaaactggcacaagacaaggatgccctctttcaccattcctattcaacacggtactggaagttctggccagggcaatcaggcaagagaaggaaataaagggcatccaaataggaagagaggaagtcaaattatccctgtttgcagatgacatgatcctatatctagaaaaccccatcgtctcagcccaaaagctccttaagctgataaacaattttagcaaagtctcaggatacaaaatcaatgtgcaaaagtcactaacattcctatataccaacaatcaagccgagaggcaaatcaggaatgcaatcccattcacaactgccaccaaaacaaaacaaaataaaataaaacaaaatgcaatacctaggaatacagctaaccagggaggtgaaagatctctacaaggagaaatacaaaacactgctgaaagaaatcagtggtgacacgaatgaatggaaaaacattccatgaacatggctaggaagaatcaacattgctaaaatggccatactgcccaaagcaatttgtagattcaatactatccctatcgaaccaccaatcacattcttcatagaactagaaaaaacttttaaaattcatatggaaccaaaaaagagcccaaatcgccaaggcaattctaagcaaaaagaaaaaagctggaggcatcaagctacttgacttcaaactatactacagggctacagtaaccaaagcatggtaatggtataaaaaataaacacatagaccgatggaacagaatacagagcctagaaataagggtgtacacctagaaccatctgaccttagacaaacctgacaaaaacaaacaatggggaaagaactccctgttcgataaatggtgctgggataactgactaattatatacatacattgaaactggaccccttccttacatatatacagaaataaactgaagatggattaaagacttaaatataaaccccaaaactattaaaacgctggaagacaacctaggcaataccattctggacacagaaagtggcagagatttcatgatgaaaatgtgaaaagcaactgcaacaaaagcaaaaattgacaaatgaaatctaattaaactaaagcgtgtctgcacagcaaaagaaactatcaacagagtaaacagacaacctacagaatgggagaaaatatctgcaaactatgcatcagacaaaggtctaatatccagcaactacaaggaacttaaatttacaagaaaaaaacaaccccattaagaagtgggcaaaggacacaaacagacacttctcaaaagaagacatacacattgccaacaagcacatgaaaaaaagctcaacatcactgatcattagagaaatgcaaatcaaagccacagtaagataccatctcacaccagtcagaatggctactaagaagtcaaaaaataacacacgctgatgaggttgtggagaaaagggaatgcttatacacagtgggagtgcaaattagttcaaccattgggaaggcagtgtggtgattcctcaacaagctaaaaaaaggactgcaattcaaccctataatctcattacagggtatacacccaaaggaatataaatcattctatcataaagacacatgaatacaaatgttcactgcagcactatctgcaatggtaaagacatggaatcaacttaaatgcccatcaatggaaaactggataaagaaaatgtggcacatatacaccatggaatactatgcagccataaaaaagagtgagatcatgtcctctgcatgaacatggttggagctcgaggccatgatccttaggaaacaatgcaggaacagaaaaccaaatactgcttgttctcacttataagtaggagctaaatgatgagagcaccgggacacaaagaggggaacaatagacaatggggcctaccagtgggtgaagggtagcaggagggagaggatcagaaaaaataactattgggtaccaggcttagtacctgggtgatgaaataatctatacaccaaacccccatgatacaagtttacctatataacaaacctacacatgtaccccgaacctaacagttaaaaaagaatcggctgggtgagtgcagcaaggtggcagaatagaagcctatactgtctgtcctcccccaacaggaacaccaaattttaacaactatatgcacacagaaaagcaccgtcacgagaaccaaaaatcaggtgagcaatcacagtacctggttttaatgtgtacggctaaaagaggaactgaaaagtgtcggagatatagtcttgaatcaccacccctcccctatctatcagcagcagctgcctggtatggcgagctaacttgcacacttggaggagggagagagcagcgactgggggacttcacactgaattcagtgctgctctgtcacagtggagagcaaagctgtgctgggctcagccaacacccatgcatggagagatcatttagatcaactgcccaaaccagcagtcagaagtggagtttcttggcaagccttgccaccgtaaagccagtgctctggggtcctaggtaaacttgaaaggcagtcttggacacaaggcctgcaattcctaggcaactcctagtattaggctgggcttagagccactggactatggtggcatgtgacacagggagacaacagccagggcagctaagggaggccttacaccatttctccctcaatcccaggcagtgcggctcgcagcaacaaaagtgactccttccttctacttgaggaagagagtaaacaagactttgtcttgcatcttagataccagctcagtcacaatagaacagggcactgggcagagttgtgagacctccattccaggcccattcctggatgacaaaatagacaaaatgtgggccaagggaacccactgccttgaagggaagaaaccagtcctggcaggattcattacttgctgactaaagagccctcaggccctgaataaccagcagcaatatccagatagtacaccacaggccttgggctctgggacgtgctgactttaggtatgacccagcacattcgcagctgtggtggctacaacaaaagactccttttgtttgagaaaagcagaggggaaagtaaaggggactttgtcttgcatcttaggtatcagctcagccacagtgggtagagcaacaagtaggctcttgggctccctgaatccaggccgagcctcttggacagtatttctggaccatctctgggccagaggggaactgattgtcctgaagggtgagccccaggtctggcaacattcgtcacagaatgacagaagtgcccttgggctctaagtgaacattggcagcagcgtggtagaactcccatgggaccgtggtattggtggccaaaaggagagtctccttttcctgtggaaaggggagagaagagcagaaaggacccagtattgtggtttgagtgccaggttagtcacattagaatagaacatcaggtaaaattctaaggtttttgactctaatccctggctcacagatagcatctctggacctgctcagggtctgggggaacttactgctctgaagggaaggacagaaacctggctggctttgtcacctactgattatgaagtcctagggccttgagtgaacacaggtaagcaggtagcgactgcagtgggcttgagagaaacccagtgttgtgttgacatcaggactaatccagtgcagttccagtggtggtagccacagggatgctaatatcaccacatccccagttccaggctgctcagtatatagagagagactctgtttgtttgggagaaagtaaggtaaaagaacaagagtctttgcctggtaatctggagaattcttccagatcttatccaagaccaccaaggcagtacctctacaagtctgcaagaaacgaagtgttattgggcttaaggtccaattcccttggaatgcctgggaagcctcctcaaggaggacacacacaaacaagcccagactgcaaagactaaaacaaatacctaactcttcaatgtccagatattgacgaacatctaaaagcatcaagatcatccaggaaaaaatgaccccaccaaatgaactaaaataaggcatcagagaccaagcgtggagaaacaagagatatgtgaactttcaaacagagaattcaaaattgctgtggtaggggagctcaaaagaaattcaaaataagagaaggaattcagaattttatcagataaatttaacagagagatttaaataattaagaagaatgaaacagaaattctggagtttaaaaattcaattggcatactgacaaatacatcagtctcatattagtagagctgaccaagtaaaagaaagaattagtaaacttgaaggcaagctatttgaaaacacagagtcaggggaaggagataaaagaaaaatgagaataaagaagaatgaagcatgcctataaaacctaaaaaatagcctcgaaagggcaaatttaagacaaagagatagtggtagaaagtttattcaaagggataatatcagagaacttacaaaacttagagaaagatcaatattcaagtacaagaaggttagagaccaccaagcagatttaacccaaagaagacatttaagatatttcataatcaaactcctaaaggtcaaggataaagaaaagatcctaaaagcagcaagagaaaagaaacaacatacaatggacctccaatatatctggaaatgttacaggtcacgagagagtggcatgacatatttcaagtgctgcagggaaaaaaaaaaagaaaaacaacaaaaaaactttaccctagaatagtacatacgatgaaactatccttcaagtatgaagagaaataaaaaccttagacaaacaaaagctgaaggatttcaacaacactagacctgtcctacaagaaatagtaaagtgagttcttcaatctgaaataaaaggatgttcgtgagcaagaagaaatcatctgatgttacaaaactcactggtaatagtaagcacgcagaaaaacagagactattgtaacactgtaatggtgttgtgtaaactactcttatcttaagtagagagtctaaattatgaaccaatcgaaaataataactacagcaactttttaagacaaagacagtacaataagacataaagagaaacaactaaaagttaaaaagcaggggagataaagttaaagtgtagagtttttattagttttcttttgcatgtgtgcttgttcatgccatcagtactaagctgtcattagtttaaaataatgggctataagaaggtatttgcaagcctcatcatggtaaccttttaccaaaaaggatacaaatggagacacaaaaactaagaagaaattaacataccaccaaagaaaatcatcttcactaaaagaaagacagaaggaattaaagaatgagatcacaaaacaattagaaaacaaataacaaaacggcagaaggcagtccctacttgtcaataacaacattcaatgtaaatggactatggactaaactctacaataaaaacacacacagtggctgaagggatgaaaaaacaatgcccacttatctgttgcctacaagaaacatatttcaccaataaaaatatatacagactgaaaataaagggatggaaaaagacattccatgccaatgaaaacaaaaaaaaaattgggagtagctatacttagacaaaatagatgtcaaaacaaaaactgtaaggacagacaaagaagatcattatataatgataatgcagtcaatgcagcaagaggatacaatgattgtgagtatatatgtacccatcactggagcactgagatacataaagcaaatattagaactaaagagagagcgagatctcaagacgataatggctggagacttcaacaccctactttcagcattgaacagacagatcttccagaaagaaaatcaccaaagaaacactggatttaatctgcactaaagaccaaacggacctaatagatatttaccgaacatttcatctaatggctgcagaatacacattcttctcctcagcatatggatcattctgtaggatattccatatgttaggttcacaaaacaagtcttaaaacattcaagaaattgaaataatatcaagcatcttctatgaccagagtagaataaaactggaaatcaataacaagaggaattttggaaactatacaaacatatgaaaattaaacaatatgctcctgaatgtccagtgggttaatgaaaaaattaagaagaaaattgaaaaatttcttgaaacaaatgataatggggccaggtgtggtggctcacgccttgtaatcccagcccttcgggaggccaaggtggacggaacacctgaggtcaggagttcgagaccagtttggccaacaaacatgcgaaaaatataaaaattagctgggcacggtggcaagcgcctgtaatcccagcttcttgggaggcttgaggcaggagaatcacttgaacttgggaggcagaggttgcagtgagctgagatcgggccacgctgcactccagcctgggtgacagagtgagactctgtctcaaaaataaataaataaataaaaataaaaaataaaataaaaataaaaaattgctcactagcaattgggagcagggttgggtcggagttaagactcctaaggaaatagttgtgtgcacagatatgtcttttattccctcctgaaatcccattaaaatgacaaaaatgggattgcacacacacacacacacacacaagcctgaaaacgagaaagcagatggatgagaggcaagtgtattaggcttgggaaacttgaattctaagtggtgagtggggaaagctgaaaactaccccaatctatccactgaagtgcccaaggctgaagaaatttagcaccaggcatccctggacgtgaggatgaaggattgcttcaagtctctaaaatgcagttacatgcccagatcctgcccgccagccaccagtttctatgtaactaagccactcttcctcccagcccttgcaaaatcccggatgcttagtctctggagaggataaattaggattctgaactggcagagacaggaaaatttgtgggcaagggtattctactaaaacctttgaaggattaagtgaaattgtgcaaactaaattctgagacctcagctgtcgtctcctacttggctacataacatttggcagttgggttttcacctccaggaaagagatcagaagaccattctccagggaatctgataagccccagaagacaagcctacaaaataacccccattggtccccttggacagcaattgacaagttgcactcatatgctcagggatgtcaatctgctttgagtttcccagtcttaaatacagcacataatcaagattaccagacaccaagaaaagctgccaaatagaaaagagagactaaaataaatagaggaaaagacagcaaagagagattacatagcgaaaaaaaaaaacttcacaggagttccaaatgtacagagcatacaaagtacagggaatgtctctgaagtaatttagaaagcatgagtttatagatggaaagaatccccaagagagcccagtacaatggctaaaacagatccacacctggatgcttcatctaaacattttagaatacgagaaaaaataaagattctaaaaacttccaggaagagaaaaaccaggaattctaagggctttggaattttctttttttttttttttttttttttttttgagacggagtctcgctctgtcgcccaggatagagtgcagtggcgtgatctctgctcactgcaagctccccgtcccgggttcacaccattctcctgcctcagcctcccgagtagctgggactacaggtgcccgccgccatgtctggctaatttttttgtgtttttagtagagatggggtttcactgtgttagccaggatggtgtcgatctcctgacctcgtgatccgcccgcctcagcctcccaacgtgctgggattacaggcatgagcaccgcgcccagccaaggcttcagaattctctatagtaacatttggaattaaaaagaacagactatggcttctaaattctgaagtaaatgatttccaatccagaattctcactagcctaactataaattatatgtaagggcgataaaagactttcagtcatttagatctcaaaagacctcctcagtaccttttctctgaaagctaagggagaagagacgctacgcaaaaatgaagagcattaaccaggagagaaggccacaggagatgggagacagcatgcaggatgcaggagactgcacatagcacagaggtaaaggaattcctggaaccaggtgaatggatatcccaggatgacaggaaactgcacctagcacagaggtaaaggaattcccagaaactggtgaatggatatcccaggatgaaaacaggcaccaagtaggttagaaggaattgggaagagatttcttccaaaagatgaagcgatgaagttctgacaattctgaacacactgagaggatgtttaattctggcaaagagcatggagcttgtaagtgataacaggaaagtcagcacgttttaaaataatacaataattacctctaaggcaaacaaaagctgtgcaagaaaagaaagttaaacactctgcaacacggttcaactgtgtataacactgtcataaatttaataccattcacgctgcctattctctaattggcattatggtatatcaatattaggagaatgagaagggaacccattttggcagggtaggtgggtgaggcatgaaaaaaaagctaaagtctcattttccatagtaggaattcaacagataatatttaaaactgaataatcaagacaaaaaaatataagcatgttatttagagacatgaaagagaagctataaaaagtagctaaatgaggtataagtggtcacctctgagaatatgaggaatgaaggcagaaatctcctacttttagtaaaaacttacagatacaactgtttggttctctaaaatgtgtacatggtaaaactgaaatcaaagccccaaaccaaaaccaaacagacaaaaaggaaacaaacagaattaatctatggtaaattcatatactttccaacatatactgaaggaaaggctggagtgaagaactgactttctatcagtttccatacagtacttactgcagactgaaaagcagtctgagcatcactgcaaagagcaagtggacacgactggaagtgtgaggagcctggaggcagcaaggctgagaataaactcaagcaacagataactagcaaatacacaaaaagagaaaaagaaatcaagacgatatacagagcaagacataatgtcttttcatcaaccaaaattcatttaaatgtcatgctctttctagattaatcccttctgtacatttaagtgatgtagggtattctaggtcaagactttcttgctttctttccaaaaggtacttaatgtaaaaaataggctttttaattacagtgaacattcatcaacacaatgggatcttaaatatataagccttcctttcaacagatttacccttgaattttaccattcactaaatgtgagcacaaaatacatctaaaataaggcacaagagttcctcatttgcattactacttttagatatcagatcaaatataaggagcaaaattaattcattatctcaactgattaatatatcaattatagacaaaatctactacatatagagagatttttattgatcttgttatctatatgtatttgcaaataaaacatattgagcacagtaggcccctttatccttgagggatccattccaacacccccagtggatacctaaaaccatgaatagtacccaactccatatattctaagttttattcctataaatatgtaactacaataaagtttaattataaattaggcaggtaggagactaacaataataataacagaatagtataataaaaattatgtgattgtggcctctctgtctctctctctaaaatatcttactacaatgcactcatccttcttcgtcttgtgattcatcagtctgataaccaagattgctatactaagtgatgaatgggcacgtatcatatgcagcatgggtaagctagacatagcatgattcacgtcctgaggggagacagagcatatttcatcatactactcagaatggcatgcaatttaagacgttaagtattgtgtatttctggaattttccatttaatatttctggactacagtcaaccatgagtaactgaagctataaaaggcaaaactacagataagaggagactactgtatcttcataaactagggaaggtaaaatctctgctaagtcaaatgtgttcagtattttatggacaaaagacagctgaatatttcttagaaaatgctcaaagtctgaaaccacctcaaaatggacttagaaaaaaacacttacacatgacttaagatgtaagtatgaatactttcaacatgtatcccctatgggatactgctataaagcaccatttaaaagataactctgaccagacatttaactgaagttccaatacagtgatttgttaggaggatggagattttagaggcagctgaaacttagtaataatgtaataaaagcctatcattttgcacttgaagaactgaatcccaagaagttaagtgatttgcctaaggtcccatatcaaatgttttttgagtatgattttacagaaaacttagacctttgaaagacatcaattttagaatataatttcttcagataatttaaagactgtaatttactttgcttcatacagcacctggcccaaaccacagcctccatggacatatagtaagctacatttattacttatcaaaacgtgttgctgttgaatgtattctaataatattttaattcacatatcctatttctataaggcaaagaaaacagtgtttgtaatttaataggcccattaactgtcccaacttacattaggtacacattttgtcatgagtgtgccaggagtatacttcctctcttcactttctttgtcttaaacttgcctgtgcctttctaacagatgtcatgtatccaaattctactgcttacacgaacacaaagagtatgatttattaggaaacatggtttaaataattggttaatgtatccataccctcacaaaatacgtgatttgtaatttagagaaataaagaggaaaattagctagtcattaggaaaatcattgagatattctgtgactgtaggctatctcattttctttgtccaaaaaggtaacaaaaaaattataaacaaaagcttttataatgaataatattacaaagtattaggtaaaaataagggcaaggtaaatttcacaaattcctctagcacagattttttttttcctgcgtatactattataaactgattcattaccctacatggatccatatgcatcatgagtctcatcagagacccttcaaacacagcaccacaaacaacattaaagagttgggaaataaaatagccctggctttgcctggctggaagtctttaaatttcccaggtccaggaggattggttgcaggacacccacagtcatccatgcagagccaggctcccacacctattgccattttggcctcagcagggagggcagggcccagcacactgccctcactgcactcagtcctctgagtgaagtcactgaaattctctgacgagccaagtgtgtcagcaagagcaaaagcctttccccaagcagtaccgtgctccaaccaaagccaaagttgggaaatttataattaaattacataggggttgtggttgggagacttttgaaaaggtttgaattttcctccttacaacattctttaaagtgcaaaactggagactcagttaatcattgggaaataaagtctgttgttctgatggggaatgagaaaactgggacaacgtccagtttttgttttcaactaagaaaatttgagtgaactgacagtgaggtagtaggtacaggaaagctatggcctcccaagaataagaggcttttagagaaatgctttgaggaacgcttctcccctagagctctatccaggcttctgaaggcgctgctggagatggatgagaaaatgggggatgccttaacaggcttcttatctatgctggaaaggtaaccagattttgtagcacaagggagacaaagtcccctgaggaccctgtgacactctccacaggacagctcctgggtgaaccaggaagcattttcttcttactggcaatcctttctgcatctcaacatcatcaagccttgtgcccaaaatgcacaagcagtcataccagaaatatctgcatgatcatgactctcacaggcaaagaagtgggtaaaaatctccaaattctaagcaacaaagggactataacaaatcagcacaggaacaatcttctaagcaacaaaggaattataacaaaccagcacacagacaatcttctatctttgccaaacgtggctggctgattgggaagctgaagcaaattcttcaatcaacaattctactacttttctgcctttcagtgagaagacaaaaatcataaaaccacatgattaaaaagaataattctaaatactgaaaaatctaaaaatattcctatttgtaaaaaacaatgtacaactttaacttagtaaacacacagtttttaaaaaattactcatctacttataaaataatactttagtgattttagaatgttttctgattaacaaaattcttgattcacattttagactgtaaacataattttataagataaaacaggcaacagggcttggaaagggggcattttcttccaaatgtgccagacaagtccacttacctatacatgtaaccaaccccaaaaatctgtggtccatttctagaaatcaaatgtcacttagaatatattttcagagacgtagatatatctttaaaattacaataaattttgaaccataactgcatttctgaaatatatccattttggtcatgatatgaaacactgttttgatcaactgttagatttagattagtaatatttcacttcaaatctttacatcatattcactgaagaaactggtcaacataagcgggtggggctaaggaggagatagttaatttaactttataaacttttgtatcatttaaacagtcataataagcattactatttcttaatttaaatgactgagacagtttttaacaagaccatgactgaaagtcaatttatttaaacgctaaataaagtttttgaaaaaccaagaaatgacgtacctgaaggattacatcactaagttgttctagagatttctgattttcctgagagtcatcaagaagtgaagccactgttggactacagcataaatgtgttttgctcttagcctggagatgcccttttgcttcttcggtcaagagaacagaaaggaattgcaagctggcagtatacagggcaggacacgtggcagacaagcctgcacatgtgcagaacatatctaaaggaataatttcagatgtgaatgtttgaaaatttcttcaaaattcaacaaaaaggaaatcaagttgattttaaagtaactatactctggatcatctagattaccaacttgtgtgattgtgttgcaactgttaaaggagctggtgccaaccagaacttaaaagcaagacttagtatgcagtgttggcacaatgtacaaacaaatatttcatagcagttcagacagcacatgagtggtcatgaactgattcacaaacttaatacagagtggaaagaacagaccaaactgaaaggaatttacactgaaacagtcattattaatttcctgttgtgagaactgattttgtttaatcaaaattacatgtgttgttttacattttataaacttgaaaaattggatttataattttgtttgattttatattttagatttatgcttgtgtgataattataaccataaaaatttttacttagattttggcttgtacaaattaaagttacataagaaaaataaagtagtcagcagtagggtttcatgagaattatgttcatttaaatgatgtccaaatattagtcaagttcgagaaaagactcttatagataacacaagttacggagtgaccacgacatgttttaaatgtatatgggcatatgagatggcaattgatttaaaaaaataaaaataaacaaaaataaaaccatggcaaaaaaaatgataattgttattaatgttttcattaacattactattatgaaaaccatttatgcagtaagttacttttgattagtactattattacataaaactgtacacatattttgaaggaaggttttgaatttaatatgtatttattttatcactaaagaaatagtgttagataaataagtttaagtcagaggtcagcaaactttttctgtaaaggtccaagtagtaagtattttatactctgcaggtaactggctttttcacaactattcacctcaacttttgtagcatgaaagcagccatatgcaatatgtaagtgagtgtggctatgttccaataaaactttatttaccaaaacaagctgcaggccagatttatctaatgtgggtagcatcatgctttctattgatattattggtgattcaggtgataaactaattttcccccaataaatacaagaagaaaatcccaatgtcttaatcagtcaatctctttcaattattatattttaaacaaaataatgatatcctacgtggacactgtactccatggtagactcagaactcctacatccagaaaattaacaattctgttccttgttaaacatgcatttgccataattcttactatcgctttggttaaaaattgtatcatgcatttaagtttactgaatgatcaaatgataaaataaatgttaaaaaaaatcggtcagttgaattagcaggtactttggaagcttaaaataactcaattttgagtacatttaagtaggttgtttaaaaaggttacataaatgtcagttatgaatatttatgttaaaaaacagcttttttctatgctaaaatttaggaggcttcatgaaaaattaaagattagttattttaaaataatcatgtttattttagtgggcaactatcatgaaaaacataaaaataattatactatactcttggcatttctgtactataagaaaattctgatgtgatgagaaagttatttgtatcctaactttccatgttatcatgtataccagattttatatatgaagatgtatccacatacaatgtacatatgtcagaaaggatactggtttctataccaacacagtaaaatttatctcattgttttataatcatatcatatgtacctttataaaaccacaggcttacaactgacaaatgggatctaaactaaagagcgtctgcatagcaaaacaaactatcatcagagtgaacaggcaacctacacaatgggagaaaatttttgtaatctatccatctgacaaaggtctaacatccagaatctacaaggaacttaaacaaatttacaagaaaaaaacaaacaaccgcatcaaaaagtgggcgaaggatacgaacagacacttctcaaaagatgacatttatgcggccgacaaacatgaaaaaaaacccatcatcactggtcattagagaaatgcaaatcaaaaccacaatgagataccatctcaggccagttagaatggtgattattcaaaagtcaggaaacaacagatgctggcgaggatgtggagaaaatgggaacacttttacactgctggtgggagtataagttagtttaaccattgtggaagacagtgtggcaattcctcaagcatctagaaccagaaataccatttgacccaacaatcccattactgggtatatacctaaagttttataaatcatcctactgtaaagacaaatgcacacatatgtttactgtggcactgttcacaatagcaaagacttggaaccaacccaatgcccatcaatgacacagtggataaagaaaatgcagcacatatacaccatggaacattatgcagccataaaaaaagaatgagttcatgtcctttcaggtacacggatgaagctggaagccatcattctcagcaaactaacacaggaacagaaaaccaaacactgtgtgttctcattcacaagtgagagatgaacaatgagaacacatggacacagggtagggaacatcacacaccgtgtcgggggatgagaagcaaggggagggagagcattaggacaaatacctaatgcatgtggggcttaaaacctagatgatcggttgataggtgcagcaaaccaccatggcacatgtattcctatgtaaaaaacctgcacgttctgcacatgtatcccagaacttaaagtaaaatttaaaaaaaccaacagtggccaatataatgttctcaataaaacagagcttcagggatgacatctttaaaaagcttaaaaaataataaaaccacaggctttcctaactcgcttttatgttatctcaaaatgtgtttcaatttttcaaaaatgcatttttggggggctcaagaacactgcaaatttttcaaagcaagcaccctgatacctcttttatatgccatgctataattacttaactttagtgaatttacatacctaaacaggcagaatcattatctcgttttattagcagaaagcccccaagattatgcaagtatcttcttaccaatcgccgctgtccagtgcttggccagggccacggtaacaaacgggagtgtgatggcaccagctttcctcaggagcatggccagaagattaaataaatgtgtccatgtgtgataaaaagctgatattaactctttatctataaaattaatcaaaacacttcaagttattaacacaaagaaggaaaagaacctttcaagatataaaacttaccacagacgcttcattacacttaaaatgaggggtgtgcacttatcaaatgaagacaaatctaattcagcattatccaaaatttatttcaattaacttcttttccattgcttcttaagatatctcccctccaccctcctgcatataaagccacactcacaaactctcctcttattaaagcatactcaagaacaatcagaaggtgtgacaaactaaatattaagccatgactgcagaactacatattggcacattataaaaatatgtcattgtttgtgctacttttgtcagagtaagttttcccctatttcctttatcccctccagcagctttgggcaggggtgaaaggaaagcacagtgtgccaaggtcaaggtagaaaagaaagaatttctttgaagaaccaagaaaagtatcatcccacaaagaaaagtatgacgcaaaagaagattctgcagcttttcctatggctaaggatgtagcaattctaggatgaggacccattttcccttctctccactcaggtaaatggaagctggagagcagtcgctgaggactctctctgaccatgccttcagggggatctgtcatcttttatctaattccactataatgtaaactttataggacgttaaccccgaggagatccatctaggtgtacttcagcacctatgagatacttgaaaactgcaccttccccagggcaatccttggtgtttctcaacccttttgtcattagtggctctctaaagagtttatttcagaaaatgtttcctcattgccatccccacaagattttaattccacacatatactgtatatctctttatgtactatatgtatatctgtactttgtacataaaaaggctaagtatagagcttactgtttttattcaatacaggcttaagaagagccgaataaaacatttaagctgaaaattaaattaaaaattaaagacctattaataccaaatttagctttgcacctatacttgctgaataacttttcatgtaatttatttacttatatatatatatcatcacaatgtgtcaatttacatacataaattagcaattcatataaaaacaacagcaatataataaattcttataaaatcatttaaaacttatttttttcagaaaaaaattttaaaaacttctttaaaaatattcttagtgaacttttaaaactttttgctagatatgagaaaacaatttttaatttaaccagctaatagatatacattcagatattgacattttttcctttcagcgcttgatataattaatgatgggttaaacaacttttatgtaattaaatatatactactttcaattaattttcaaagctcaaatcatacagaaaagcaagaggatcaataaaaagcattcacaaggcagccaatagcagccaagatacacagaccaccttttgctatatgaccttgggatcaaacaatcaaccaaaggtcctccagctgctgtcatctattcaccacagttttgtggcactagtcttgcatacatcttgtgtatcttccatgaactcaacgtcaatgcttctcaaggaattctcaagaaaaaccaggaagagaaatagtaataagattgtctcaggtagagttgagctttggaagcctacaaactattttaatttctaagatgtttttgcctcaccctcttctccccagaatcaatgttcactccttagagactgggggtgatatcaccttgttgagcttgtccagtctaacctaataagcttagttagggtatcactgccacttgttgaatttctaaggaattactattcctttaacatcgagatcattttaacactgatgagatgctgagaactggctttgctgggtatcataacacacttcattttccagacctaaaaccaagtaaatccatagttcaaataaaactgaaaggcaaagagaattaccaaatggtcaattacttcattataaatgattgttttcattttcaaaacaattatattagattttgacaaagatcctactttgctttaattttctccactaagcattacattcaacttttcatcatagaatattttcccctggagataacattagatcacaaaatatatatacatttcaataatttaggaccttaggaaatttgtgatatattctagattggcttatacttgttattgggaatgttttattaagcttttggccttagccatagtttataagaatagttaatacccagaactcactgtactttctaacatcacacagagagctttgccctcatttaaactgaaaactcaagggtagtcctttattatactacacacttgtcttaattggtaccattaaaaggcatccaaactataaaacacattatcaaagccttccaaaatactagcaaaaagaaactcaaaaagtaaccttcaagtgaatatctgaaacagagtaagttttttttcctcagtattattcacttacattctaaactaaaacaattaagcttacctaatacatctttggtacatatggtgagaattccaatgatattggtgataagaggtttcacaagctcatcctgaatcacaaggtcaggctccaccaataaacatgactgcagaagcctggacaaagaggataggtattccaggagaaaggaaacctgtttgaaaaggagacagggtcaaatcaaacatgccatataaaaagcccatctcagtgatacagcattttacttttgtaacacaataaaaaataaaatattaaccataatttttcaagatctgaaattaacacatagcagacaaagcattatttttctcataagcatgtcattaacagccatattaatactgtcaactatacaccaaacaaagcaatgttttcaaagtcaagttttgaattccatttaaagaagtaaagtcttggccaggtgtggtagctaacacacctgtaatgccagtcctttgagaggccaaggtgggcagatggcttgagcccaggagtttgagaccagcctgggcaatacggtgagatcctgtttccacaaaaaatataaaaattagccgggcctgcagtcccagctacttgggaggctgagatgggaggaccacttaagcccagaaggtagaggctatagtgagctgtgatcacaccactgaactccagcctgggtgacagagtaaaaccctgtttcaaaagaaaaaaaaaagtcccatatttttcaagtagtcaaattatgaaatcaatattatggaagaagtggaaaagtgtataacaaagccataaagtctataattttgtaaagaaagaaagattacaaaaacacccttcaaagtgcataagcaggggtggggggaagctagcctagttattgctacaaataaaatgcaaatatgttctatttttgccctcagcataaaattactattattaattataaaagaaaaaattaaatcatcttcaatattaccaacaaaaccatctctggaatttgcctgatgctaatattgttaagtattaactggcaaaagtacttttcagaaaaataatcctctgaatatgtaacaattaaagaatgagctgtgatgtctcatttgtccactaccctcaagcaatgagccagttacatataagtgaattttataaagatattctgaaatcagtcattctctctctctgtacacacacacacatacacacacacacacacactttttttcctctcaccttattctggggttgtaagagtgtaatgaagagtcgagagcctgttgtaaatttgtggagtatgtgtctctgaggtcaatggtctcagactatttacaaatagttctgccctacttctcctgatgaatacgtcctccctttatctaatctgccaacttactttatataaaagtgtaggtggctccaggcttcacaaactcttcagtttgtgaaatttaatttgtttactgccgtgaagtcttgagacttcatattacattcatactctacactactgaaattatagcaagtctgacctctggatgtatgaaatattaccataaatagataaaccatgccaggtgaggcaagaagaagtgttatagagaaaacgctgaattgctaaagattcttttgtatatgatcacattcaagattaaataaaatattcatatcttaagagtagttgataaagtaactctttttctatgtatggccctcttaaaaaaaaataccaaccaactgaccacagactttaatccatcatacctttagcagagtatcaccccaccagcagggctctggccaccccatctgccgcaggcactcgcagcctgctccctcacctccccagctttctgcttaagtgtcaccttcaggaggcccctcccctttctgacacacccttttacccatcctcaattgcttttttccataccatttgtgactatctgatacaatgcattttatttacttgttcactgtctgtctcctgcatttatggcacagactctacgtgaggagagatgctcatctgctttgttcaaggatatatcactagcacctagaacagaatctggtaaagcagaggctcaagaattttctgaaatgagtgaatgatcttatataaataccaagagcccagaagcatttaatctacataaggccagctggtgcagtggttaagaatgtgggccctggaactgacctgcataggttggaatctatgtcagagaccttggacaagtcactcatctctctgggcctcaggcatttcctttataaaatgacattaatgataacttcatgattcttgtgaagattacatgaattaacaaaaacaaatgcccataaatgtttgctactgctattattcattcatcccacaagtatcaagtgagcacctgtcatgagacaagccctatgccagacactcagaacacaatggaacataacagccagcaaggtcctgacttcatggagctgactgtgcccctctggcctcatcttgccctcatagattctgctccagcgactccaccctccttgctgtttcttggataggccaagcataccccaacctcaggggtcttgcaatgaccataggactagcttcttcactaactttgggtcccacgacactgcctaatcatcctaagtggaatagccctacccttccaactctgacatcacttcctgtcccctgctttagtttttcttctgagatgtctatcatcttcaggcatatatggattttctaattatctattctcccaacttgagggaagggtctttgttttattcacttggagaagattcaggcacacagcaagtactcaacaaagatttgctggatggagagcagaaaaatggaggagacagtcattatgcaataggcatgctcaggtgaaaacactgcaccaggacaacagcttcaaagaccatgcgtgtagcattcccaaactttgtaatggggtctgtcttattcagctcaaagaacacatctcaaagcaagagatattggtctacttcacctttaattcatcacctcctaaataaatcttgtagcccttcttaaaatttgattttgaaataaaatttctgttagcaacagctacatgaataattgttaagcatgttttataaatagattctagctataggcaagaatttaaaactaaatatctgtgaaggaacaagaataaatcatttttatcaaattgggttttgaaaatacacataacttagccaccaaatattttaacaactttaactttggtgtaaataacagagatagcctaaaatcacagaagcaggaagtgaactataccaatgtccctctttattattaaagtggtgctccaagatatccagacacttgatcatacatttaaagctggttaatgatggagtcaagaatagaatctaggtcttcaaaccccacctctcttttctaacatccagacatgtcccatattaaaatttcaagtaacgtatttcgaataatctcatcataccatgtatattttgagaggttttcatccttttcctatgactagtatctcctcagcaagatttttatttttgacacctaacgtaaacaaacccacaaacagacttgagatgcttacctgagcctgagtgtgttcagctggaggtgatgaaggcagcagggctctgagttcctggacacatgtctgtatgagggtagcatctgcaatgctgtgacgatcagaaaaagaaaatccttcagaagattagtatactttttattaaagattaagaaatcagaatttgaagtttaaaggtaactcgaatacaattcaagagaaaggatctttataagcaaagaaaatgtttataaaaagatatctcaaagaatttcaaattgtatcctgggttaccttcaaacaggaaaatatcttgtcagagaaaagtgagaagcaaagagctgtgaagaaaatatctaaggaaacctaattaaaagcagaataaaatataatacagcccatgagtaacaggaaacttggtggttattttcctaataaaatagcaaaaatactggctaaaatagcaagaacactgttcatatttagaaagtaaaaaacaaaataaagtaaaacaggccgggtgcggtggctcacgcctgtaatcccagcactttgggaggccaaggtgggtggatcacctggggtcaggagttcaagaccagcctggtgaacatggtgaaaccccgtctctactaaaggtaccaaaaattagctgggtgtagtggcagatgcctgtaatcccagctactcaggaggttgagacaggagaatcgcttgaacccaggaggcggaggttgcagtgagccgagatcgcgccactgcattccagcctgggcaataagagtgaaactccgtctcaaaataaataaaaataaaaaaataaaaataaagtaaaacaagtaggatttttttaaagtcaaaaatgaaaaacaggtacggaaatatgataagcctttgccataaaaggtcttttaatgcccctgtggcctcaatgccacatcagactcttagctgactcgtaagaagcaaagaagatcctatccctagagctctattttggtcatcttcaggcaggagcatccaggaaggaaagccaactgactagcagttacttttccaatccgagtaggtacagtaaaaaaatgatcaataaatattaaagccagaacaaactcatactccattgcgtatcatacatgttaaaggaataattacaattgaatgaggtgaaacaaggaatacttcttttagagtttatattttctagagttttcttaatatcccagaaagaaagagaagacactatgatttggcaagaagatgcaagacatttcagatggtgtatgttcaaaggtaaagggacagagagacagagaaatgcaaataaacatgtggtcaaaaggaggtgggtatggttggctagaataaactgaacaccagaagaaaagagaagtaatacttaagggggtatcctagataccatcacttttaattctcacactaaccccattaaataggtgttaatgacacagtagggagtaatttcccaaggctgcaagctactgagtgaatgaactataattagaccttaggtcaacctgaattcaatatctagtccttttctactataccttcctagaaattcagaaaaattatgttacagactgattaatatcaaataagtaataaaaattcaaataatttttctttgaatttaatttccctaaattttatcagaatactttttgatgaaaagtttaatttcccttaacaaaataactccaaatgaatttaaccaataatttttcaacccagggacattattctgatatgaccactaaaaagatgaattcccaaagtccctcacatccattaagaacaggggatagcaccatattccttaagtgtgctggaggataaataaggtttagaatccatgaattttagaaagcaggagtttttctttggccttaatagtcaagataacaaactaatacaagtgctttaatagatgtaaaataaaaaccaccaagacaattctggcaaaagcaaaatcctagagttcaatgagcctaaaaaagaataaagctgtatttccaggtcacaagaaatcttgtatcaagtcatgaatacagtttgtgtaaatttatctcaactaacatgcctctctaggagtatttatctcttacctacagagaagttctatgagatgagcttgtcgaaaagcctttgcagtgtctctgggagcaatcgtcaagaggttgtccaagaggctgcacattgctgaaagaagagatggagtaacaaaaacacacagtttgggcaggggagcagaaagagatgaatcatgaggtggccgtggtgatgtactttcctggtgacctattattgaaaataaacataagaattattatttaccttacagctatgtacaatactcaaaagttcttataatcataggaaagttcctgaaaatgataatgtatagttggggaattgccttagcttcttggctcatcttaaccttgaggttaggggtcaggctacccctactactcctgacctccaccttccaccatgtgtggatgtagatgtgtagatgtgtacacacggacattgtcgtatgcagaagagacaggtcagaaagggcagaacatgacttcatgccccacgtattcagacactgagaacaaaaagatgatttacaatcctttttctgaaactcgaggggccaaaggtgtgtccaaattcaaataatctttaggttttcttcagagtaaaatcttactatttttattatttttaaatttttaattatggatatataatcattgtacatatttatggggtacacatgatattttgatacaggcatactatgtgcaatgctcaaatcaaggtaactgggacatccatcacctcaaacatttaccatttctttgtgttgggaacattccaactccattcttttagttattttgaactatacaataaattattgttaactatagttaccctgttgtgctactgaacactagatcttattcctcctaactgtattttgtacccactaaccatcccttctttatctctggctctccactctttagcctctggtaaccctcattctactctctattttcatgagttcaactttttttttttttagttcccaaatatgagttgcaatatttgtctttctgtgcctggcttatttcatttaacacaatggcctccagttccatccatgttgctgcaaatgacaggacttcattcttttctctgagtaatatttcattgtgtacatatatggttcattttctttatccattcatttgctgacggaacttagactgattccctatcttggctatcacgaatggcgttgcaatcaacatgggagtgcagctatctcgtcgatatactttttttttcttttagatatatactcagcagctggattgctggatcagagggtaggttctatttttagtttttgaggaacctgcatactgttctccacagtggttcccaacaacactgtatgagagctcccttttctccaaaatacttttagactttagaacagtaataaggtacctgcaccctacattagtgaacacctccattaacctttgagcattcccttactttctggcacagcaagatgttccaggttcatcttgttctttcctcgtccaagctctaaaattggatatttgttccaaagtgtcgattccctaaagtggagaatggagtttggaaagcaagatttgggcactaaatgtatacattgctatttagagtgtcattgtttctaagctagaaaacgtgtgtgtatatacgtatgcatgcacatacatacccctgggcacataaacatattttatctacgaattaaaaatcattaatttgcctgtaattccagaattttgtgaggctggggtaggaggatcactttaggcaaggagttcaagatcagcctgagcaacatacagaaacctatctctacaaaaagatttaaaaatgaaccaggcatggcggcacattcctttaatcctggctactcgggatgaggtgggaggatcgcttgagcccaggaggtggcaactgcagtgaactatgatcacagcactgtcctccagcctggatgacagaatgagacctcatctcttaaaaaacaaaataattgattcatactgaaagctccaaatataatccaacactccaaatataatccaacattaaacatcttccttcccttccatatttgtaatttccgttatgtgaaagtaaaaattctggctttcattgtctacaatatatttacttatttgccttgccttatgaacacaataagtagtttcagaatttctaactaataatactgcaaaaaataaaactagtaactagagttcaatgcttggttacagttcattttgccaatagtctgaggactaaagtcctaaaaatatgtctgagagttactggggttacttcctctctcacttcaatgctattcatgtgaaatgtagctggattaattggtttgtattccatgttattgtttcccatttttgttgattttatttttttcagcaagtaaaacatacatggttataaaagtcaacctatacaagaagatacatgcagagaagggtcactatcccacccctcaatctcttctacactgttcccatcctctcttatttcctaactaactcccacccattctcataattaatctcattcatttccagctgttccttcctgttttctttctacacaaatagatacacgtattttaaatttccccttctttcatatgcaaaagtagaaaactgtaaatatcataaactataaatactctttatcattgtgcttctttcttcacttgacaatatttcctaaaatttggtccatatctgtttgaagatatcctcccctctttttttttttttttttttcgtttttggagaaatggtctcactgttgcccaggctggagtctggtgcaatcatggctcactgaagcctcaaagcctgggctcaagtgctcctcccacctcagcctcctgagtagctgagaccacaggtgtgtgccaccatgcctggctaatttattttatattttgtagagatacagtctcactatcgtgaaaagtatctcccacctcagcctccaaaagttctaggattattggtgtgagctgctgtgcccagccccctctttctaatagctgtagttctccattgttattttaaaaataaattttatttataagtaattttgttatatgtttatcattatctatatattgttatatatctatcaaaaactatccttctacttacaggcatttgtgttgtttccatgttttataattacaaacaatgcttgctaaattatcaagtacatatgtatttttatattgctggagataaataaaagagaattcctagaagtggaattgtttaatcaaaggtaaatacatagttttgttatctattgccaaattcccttccaaaattatactaatttgcattttctctaacaatgtatgaaagtgcttattttccacagcctcgccaaaagaatgtactgccaatacttaattgttggcaatttaataaataaaaaagtatcttcgggtagtattaatttgtataatatttttccaaagataaaggctacttttaggtcctttgtgaattatcttttcatgttttctgctcatttttacatgagagtttgtgttcttttcccctcaaatattacgcctgtaatcccagccacttgggaaactgagacaggaggattacttgagtccaggtgttcgagactacaatgagctatgaccatgccactgcactccagcctgggtgacagagctagaccctgtctcttaaaaaataatgataaatctttggaaataaaaatggaaaaaattaaattgagataattctaatgaaaattgtccaaacaatttcaagggaaatctttcagtattcataaaatatgtattacatatcttcagcacttctagagcaagcatatatagaaaccttttttgaatttttctgtaaagagagctagttcagaatataaattgatacatattttttcaattttcttgctaatttattttgtaaaactaaggaggacatttgacaccctgatctcttatttccaagttttgaaaaaaaaggaatatacctgatagtgtcatatatcaccaaaaaattgtgaggattcatcctctgttcatgcctcccctttctgtgggtattctttcttttatatgcttttttttttttttttggtcatatatatgtgctgaaatgattggcaaagagtaaaattgcataaatatacattgaaagcatactatttgtggacgggcatggtggctcatgtctgtaatcccagcactttgggaggccaaggcaggtggatcatctgaggtcaggggttagagaccagcctgggcaacatgatgaaacccaagctctactaaaaatacaaaaattaggcaggtgtaccggcacacctctgtaatcccagctactcaggaggctgaggcagaagaatctcctgaacccaggaggcagaggctgcactgagccaagattgcgccactgcactccagcctgggcaacagagtgagactgcctccaaaaaaaaaaaaaaaaaaaaaaagcgttaatacttgaaaataaaataaatttaaaatcaaaggtaatccaaacaaaaaacagaaagcctgtatatccacacaaatgcctatatcacgtgatgaatgggtaactgtaatatattcatacagtggaatattatttgtcaataaataaatgaagttctgatacatgctagaacatggatgaaccttgaaaacagcacactaagtgaaagaagccagtcacacaagaccatgttatatgattccattcatacaaaatgtccaaaacgggcaaatctataaagaaggaaagtagattagtgattccgtagagtgccaagaatgggggagacagggagtgactgctaatgggtatagggtttttttgcaagatgatggaaatatcctaaaattgatcgtggtgacggttgcacaactctgaatatacttaaaaccaataaagtatacactttaaacaagtgaattatatggtatgtgaattatatctcaataaagatgttaaaaatcagagtaaggcaacatgcttttagagataaatgttcatgaaattcatgatcgaatttcatttcatgccctatgtcctgagccatttaaataatctgagtttgctccttttgttcttaagaagatcaaatgagtattttctacagttaaataattttatatatagtgaacatgaattactaaaaaccaatatggaacactgtttaggaaattattggaacaaatattgtaatgaaagttcaaagttttaattcagcaagtttttctaaatgtttcagaaagtattttttctgcatatacttatatgtatgccagtgtttaaaattactttctttttagatagtatagtcctttcaagtcaaaaatttaatgctactgaataaggcttatatactctctagaatttaaaaaaaaaaaaaaaaagcaaagttgcaaatttgaagcacagcagggttggaagcagttcccagcacaaggagcaaaatttatatattgccattaataaaaataagtcccaagttgtatattgtgcatttctaataaaataaagactcaatacattttatgtgcctttaaatggaagcatagccttagaaaatacttaaaaccagaatcgctttactttcaagtggattacttgtagcaaagtgttttctcaaaagaagggaaaaaataaagttaagttatacccatcagttcccaaattcaaatgtcaaatacctacgagcgcctaataaggagccacacaggaattggactatttatttaagagccaaattccatttattagttaagagcatttattttattaatttctgatatattggttctaaatgtatttcataatggtctacaacttatttcattaaaattttgttctttagacatttactttcaaaatatctgtctggaccaacttgtcatttttctttttgaaggtagaatgtcttcactaaaaggataccttgagccacaaactggtcatgggaggcttcaggtagaagtgttgttgactgcacaagtggctgaaattcagtactccccaatgaaggtgccacctatgaatcagtaaattattttacttattaatgttacagtacggaaaatgaaacacaggcaacatacacacaagatatccttaaacaaggaggtttaagacaaaattatactagttaggataactagaaaagattccatatcttgggagttacagcagtttttttaaatggcatttccacttcttaaaggaattgttatcatttacataaatcagtaactcaaaggagcagtattgacttcaggcccatttaggagtttaaggttcccataaggccaattccctcattgcccaaatgttagaaaggctaaaatataccaccttaactataatttattgtgatattttgcatttcttgattgacaataaagatatttttaatgttccaaatggcacatataaattttaatagtgcctaaaaaattagaagtattaaaagatttttctctacctcacctcctatcaaggaagaacactaaaaaattgtgccagtttgctgagattgcttcagaatacaacattaaatataacaaaatccgtggaaagcaagtacaatttcacctacaggtttataatgagcagaccgaccttctaagactgaaaaagcgcaaagtgatgtgtttgcgctaagaggtgttcaactaagcacctcttagttgaaaaacacttatgtggtgaggtcagataactcttttccttaccatcaatttctcttctgtgaagtaacatgaagtgcccatacctgggtagcctccatatcagtacatgcaacacaacattagctatccatagaagttataaaccatcattccagactcagatcctatatagctcacagtatttgtacattgattgtgtatatatcttaacacttagagtaccttagaattaccatgatgaaatgaaagcaaaaactaaggttattttcatttgcagtttctaatagtaaagagaatataaatttgaagaaattactaaaaatggaatatacagttttttaaatcccccttttaacttgagcccttaaccatctttcaccacattaagtaagtataacagtcatgatgccaagaaataagtgagaaagctgcagctaaaaaatgtaggctaagcacataatctaaaaagtaaatctggaaaaaagttcagtctaaataagtcaatcataaacaaacatcaaatgccttattttatatagtattagatccagatactaagtaaaaataacctaaagcttgtttattttttttttttttgagacggagtctcactctgttgcccaggctggagtgcagtggcacgatctcggctcactgcaagctccgcctcccgggttcacgccattctcctgcctcagcctcccgagtagctgggactacaggcgcccgccaccacgcccggctaattttttgtatttttagtagaggcagggtttcactgtgttagccaggatggtctcgatctcctgacctcgtgatccgcccgcctctgcctcccaaagtgctgggattacaggcgtgagccaccgcgcccagcaagcttgtttatttttaaaaatatatttgcctacaatttggcaatgagagatatgtgaaaaaatgttcctgtcaacagatatcaagacaacatttatagttctgtgaagaaaataatcctatgccaagactgatatcacaaactatgcacaagctaatatatctggctcctgccacaactcttttggttgtataagaaaagttaaggggataatgatgctgaaatcctttatcatttcactgaacattctttcaactgataaagactcaagaaggccttattactgatataaatagaataggtacctggtttgcggtttcaacgatcggtgtgggaaaagaaagcttataagggcccactaaatacctggctcattagaagaaagcaaagttgtgattcatgacaaaggtcaggcattaataaagatgtgattttccttagtatagtccacagaagggatacacaagtttagaaaagatgcttttagaaagtaccttattgtattataacttaccccatgtggttggggaaacacaatgattgctttatatggtgctttaaaattgattatggatgatttatatttctactagcctctattttttaagtgtgctaaactaatatattgctattttaataactaaaagcaaaaaagtattaaagcaaattgtcccagttctatgctcaaatctttgcttgtttagatataatctccaatcgatagtatttggttacatttgataaagtacatcgatatgtaaacatgttacttttcaccttaaaatccaagtaataactagacaattttggcattaagtattagctactggaaggtgcagtatgagcctacgaagctataggtacaaaaagcctgacctagtccacgtcctcatttagagaaaaggaccacaagttaagggatttgtctgagttgagactaggattctcagtccagaactgcattcatgacagcataaattcgttagaatcagaggaagtcctcagacgtacctcttgagaaagctggctggccttgtttgcgaggagaggcttgcttctttctccctgatccccctgtgtccccgcggaacttcagctagactaacttcagctgccccatcccaggtgaaggaggaggaattggcttagtttaagagcaaacttagtctgctgaagtcatccgttcctgtcaagcttctcgctgctctgctctgtacctcacagtaagtaggataactagggttgtcctcttacaacagcgagagtctaattcttgtatctatcacttgctcaattcattagaatggtctaagtgcaaaatcacaatctagacttttccctcgctttcacatctgccacatgacatatcctgagatcttcaatttataatccctcggtaagacaaaaaaatctgaatttgaatatatttctagccttattactttacagatattacaaaagacaatacaagctttttagagcaggctgatgctacttaaaggtactgtcctaaaacagactcagattagtgtaatggatgttgctaggggataggagctggggaaaaggggagatgtttggtcaaagagtgcaaactttcagataagatgagtatgttctggggatctaatgtgtagcatggtgaatatggttaatatggtctaatgtgtagcatggtgaatatggttaatatggttaataacactgcacagtctacttgaaagagagtagttcttaagtgttctcaccacaaaaaaaaaaggttgactcttaggtgacagatgtgttaactaatttgactgtggtaatcatttcatcacatatacatatgtcaagtaatctcactgtatatctcaaatatatacaattttatttgtcattttagctcaaaactaggggaaaataaaaaaataaaatggactcaaatcttgcttataaaaactgaaaaaaattgttcttcagtgtgtttgtaagcagatttggtaactaaagaaggtttctaaattatgcttcagtgtaaaataagcagctaaaattaagaaagtccctttgaaatcactgaaaatagcagagtcatttgccatatccaagtagaactggaatgtaaaaaacaatttctgtcatataagcaaaaatgcatcaatgtacaaaaatgattttctttgtatctgccttacagaagcaagtgatttcactagacactttaactttttttgaaagttaattcagaacttgaatattgtatttgccaaaatgatcttgtaatagttccatcaacttccctcaaaagcagtactggtgccaaaaaagtttatttaattgtttttaaaaaggtacaaagggagaaaataaggattgtagtgtgaaaaaaataaagtacaagtctagccacattttgaaaacatggaaaaatataagatatgaagggtttctaagagattctaagcttcatgtgttcattttaataaataatacctttctctatatgcccaggagcaggaaagctttggcatgcttctcaatttgtaatcattaattctaaccaaattataacaagaagtttaaattatttcaactaatagattcataattcaaatggattatgtacaatatatgtaaaaaaaagaaagctcagaaaagtcctctgaaggaatgagcagaagatgatagacgattcttgcatgtctaaccaaaggaccacttaaagagacagatcatcaccacaacacagtcacagttcctgtgccatcctgtgtgtaatctaagagcacaaatttccaagagcttgtctcacttgtattttcctcctaactaaatataagaggttgttagactctggataatccacaggtagctgaaatttatttaaacagagtataacattttctttctctctccatcatcacacaaactaccacctcctcaagttttcctggggtcaccatgctggaggtatttgtatgtcctatcagtgatgcctatgtcaaaactatttttcttttagaaagcctcttggatccatccctgcttaaactatcctctgtctactcttccttctataaaacaattttaactaccatcaaatgagtgtcaatacgttatttctctcatatcagttgtaatgtttcatgccattccatgctgctgaaatatccttacatctttatctttatagctcttatatcttacctcttcaaatccaaaagctgattcagctttcttaactaactcctatctgattagtcaggtcatcaaactttagctttccgtcccacattctactccaaacaacctcttgcattttctgaatgttaatgccttcagtacaacacaacttcatatttagttagaaagtctaagtatgctttatgttctcaagtagacttttgtcatttgttaagtggtcactgaatcctaaggaatatttgaatcttttcagtcccttgcaaatgtttgtatgcatataaaagagaaggggataatattgtaaagcccatttcagtggccacttcctacacaaaaccacttttcatttcatctttccctctaaagaaacctcactgtcccttgactacaccatcttttatgggatcaatcacatctggccttagagtgaaggaggaagcaaacatacttctggactcaaaagaatggtctaccagttaccatgctaggaacttgaacaagcatgcactccatggagtgggacctcactccatgccctaatttcctcttttgcaaaatagtaacaatgcttttcagttgttttaagactatgaagtgtaaaaattctctttaaatgtttagaaaaactaaaatcagttttctttaaatctgtgttccagaaaaaagtttgaaagatcacatatttcacaaagaaaggctcaaaaagaaaggaattatatttcccacatattttattttgacaattgataaatttaaaaaaatacagacatagttctgctcaggaacaacagaagagaccaaattttggtcataaagctgttgctgcacacaggtgtgtaagaggcacaaacagctatccatcttggatataaacgtgatttcgagaagaaaaacaccacctaatggctgcatcctcctaccccagaggaggagaatattgagttcgatagaggccactcctgaggaagcatttacaagggcgatgccccaaagctaacaatgacactctgcttactctatctgcagtttatcaaacatacaggacccaacaatccttacgaagcttgccaaacaacggaactaatacacattaggtaacagcatgaaagtccctaacttggcattaacagcacaaaatggatagtaacccaggagagcatgctggatgacatgacccaaatcaaaagatgatgctttccttggaaagataaaatggaaaaaccagccaactaaccaataaaggattgcattttttctcaattctgagataaacaaaacaaagatataaataagcagataagctgattaataagatttacatccactcaacttatacctcaatttgtaacttcaacatttttttatacataagaaagtatgccttggtcgaagtactgacagctttggtttaaagtaacactggcagaatgaaaacactctccagatttttctcctgttgggacaaagatacacatcatcttgggtatggtaaagaaaatataactagtagaattagggtacgaagactatttttgtaactaaaagtcacccattctaaaagttgtttggaaacctcccgaaaaagaaagtaaaaagtaaattctgtaaaaattctaacagaatacactagcctttagagaaaataataagaaataaattttacacatattacaaaattcttttaaaaaaactgaaaagattccattggtatatatttctaaaagtctgtgttacattcaaacacaaacaagttaaagaccttcactttaattggggtgcttctttctttaataatgactacaattaataacatatttccaaattttctcagaaaatctagtattctaacctgtaagattaaatgttattacaaaatagagaaattcaaaaggttgatatgcttttgctttttgtatttaggttttcttgtataggataaatatgacttcagtgctcaccacaaaatagctaagataactcaaagttaattagagcaattattatttactgagtacctactaaaagcaaaaaaactgaaatatgtacaaagatttcaaggctagtctatagcccttttgacaaataggctaacaaacaaaatttacttttaagcacactttcatgctgtccttctgtgaactaaataaccaattaagacaattcagtttggcatttatcatattactgctcttgttgagacaaaggtacacactatctccaccttggaaaggaaagcatgacatctagtggaactcgggtaattatcttacttttccatacaaaggtccaatgtagcactaaacacaaatacttctcttgaatctagggaaaaaaagacttaaaactgtagcaaaaagtatcagtcttttgagaaactaggagatagattaaacataatctttacattataatgtctgtataattattattctcatattatttttgttcctggaaacaggtgtatcaaatctttcccttcctgatatgttgtataatacactaattatttcaaaaacactttaaaattaaaagtaacatttcccagttgagaataaatgattctgtatgtttgtaaataactgaaacctagtatcaatcattccttataaatactcagtgtttcaaacttttctgcaaaaaaagcaactaatgcatgaatgaaaggggaaggaaagaaggcatgcaaacaggcatatataaatttcaggtattccagataaacttctatgtgatgcaagtatttagaagtgtgtttaaagctgtcagcaccacactagaatcatttgaatgttcttcatattgccctgcccttaagcacaatttcagggtaatcaaccatttttaacatgtaggatttgttctcttctaatactaacgaaaaacatattttcacactttcgtactatcaaaaaaggtaggaaagagaggttgaaaattctcaactaaagggatattcagtgtagctataccgtagcaagacacaccctggttcaaactccagttctgctacctatagcactaatgatcacaaagttactttacttcagagtggcttgcgcacacagaaaagcaagataagtatctataatgtatgactgatgtgcagcttgaatacaataatttagcaaaattctgcagaaagcacttcgaataaatcatagctgttataaccttacactttgtattcttaactctcccactaggcaaactcaaattttttcagagattcaaaataaaggacttatgcattctttgcaagtaccgttgtttctgaggtggagagagaacttggatctcgatcctgacttgtcctagatggagccctccaaaacttgaatgagtcatctaaacctgcaacaacgagaaaattgttaacatggacaccctcctaggaactgtaacaattaattaaaagggtacgcattacaggaaaccaattcaaaactaaagaaaggaaaaaacttatatggatctggcttctgagatagaccactatttaaaaaaaaaaaaatctaaggagagtttttttttaatgtgcataagaatcactgagagcttgctaaagcagctgcttcagccccagccccagaggctccaataccccaggtcagagtggaagccctgagtgttcacttctaacaagttcacagaagatgccaatgctgttagtttaagggccatgctctaagtaactgatccagagaaatctaaacaattaagtgagtcacttttctaagagggatatttaaaatgttcaaaacttcatcaaatctcattttcttgattcttccaagaagtaaacagaaaagtgaatcacacattcacacttaataattcggggataaaggaacttcatgtcttcaacttactcttaaatggctcaaaaagagtatatatagatcatacatatccgtttatttatacacacatacacacacatgtggcaagatgtaaatactgtaaaatgttaacatttgagaattcttttgtactattcctgaagcttttctgtaagtttgaaactatggcaagattctaaaaaattattataaaaatgaatttaaaaataaaagctatttatattattaaattactatttattacaagatataattatttttatgtgctcagatcttatacttagcaaatctacaagaacctacaaacaaaaggaataaaaaggtttcaggaaaatattgtgacaaataagtaacatactaaaataaataactttttgatacatgagcaaaatgaattagaaaatatagtgggaaaaagtctcattcacaagaaggataaaaaaactgtacattgcctagaagtgaaagttccaaaaaagtttgagacgttaacagagaaagaaactataaaactgtactgatgggcataacttataaagtattaataagatgtcaaaaataatttccatgaagaatttataacatagaaaaatgcttgcagaatatttagtgaaagaaggaaatacaaaaatgtacacaagatatgaacataattacataaaacaaacaaaggctatacagagaaagaagacgggaagaaaatacatctctctgggtggtagaactggaaatgaatgttttccctgtatactttcatttttcaaatttttaaaacaaatatatgtatttttaacagtttttacaagttacatattacaaaaataaaaatacaaagatatcgtacttaccatttaaatcattgctttctgaatttctatcaaaagcagaaaaattcaaatcaaacatacaccgtcctaggtaacaatgctttaccatctgattcaaatgttcataaaaatggcagtgatataaaagagcctgaagggcaggttttccaatgagcgataggccagagtcctcatcatgaacacagggaccctgtaggaagagagggaaagaaggaggagacactgatttatccaacaatttccttaaaaagatccattgtctcctctcgaggaaacaaatgggtcccagatgctcccatctccttccactctgcttttgtccttacacagttatagcagcctgacctaggacaaattattccataatactctaggtctttgctgcctaaacacccccgtgaagggacaaagctgatctttctcttgaggggccatttcatttaaaatgtttctatggaatgatcagctttaaccaagaaatcatatacttgcaccaaaaacacaataaaagcagtatttttcaacctacatataatagtaaaataataggtgttaaaatatatgaaataaggtggtccatatattatgttcagaattattttttatacctatcactaagccaggtaaaatgaaaaggtccatcaatatccatatggcaaaatctgtcacattacttcccactgaattaatcctgacaaggaaaaaaaacacacacatgtatacatacacacacatgaactgccaccaggaggctgaaaagaatctgctattacacaatttttctctttgcatttttcccaaacaattttttgcattgtgacttactacttttcctggagtatctaatagcaaaaagcaagcaatgaggattggtttgaagtttgcaaataatcctaccattagtttataaatatttctattttctgggaaatgataataaagttaagatttcaaaacaggccataagagagagaaaaataaaagatagcaaacagaaatctaagagccaacaggaaagatacgttcaaaacatattgcaagttgacctttaaccataagatttgtatgtgtgtctgttctctcaccctccccatcaccaaaagaagatggatattttaacttactcttcaggaagacaaaggaattcacaagttaaaggcacgattacactaacaaggttatttctattaacacttctttttaaggacatttatatacatcattataattaaacctcttcaatattcaatgtcttttatgactatgaagttgttactgctgtgttgtaataaatctaccaacactgtgagcttactcgtcctaaacagagcaatttatataagaaataagactactgtaatgaacagccagcacatggtggtcactgtcgttattttaaatgcagaggtctagaagaatcaggtaaaatagagagtaatacaaagtgaatggggttatgtggctcctgtttattaaccaaggtatatgttacaggtactggcgccctttaatacattaccttattttattatatagaatgaagtattcacccaaaatcacagtcaatcttaacattcacagcttcaagaaattctatcttttaagcaagttataacatacttaaacgtacaaaacacgccaaacacccaagagatttgcaataaactgcttaacatcacaaattagagtcctcattataataatatagggaaggaattaacaaataagacaagaattgtagagggtttactagcttcactccatctaaaaaattcaataaatcaaaagtgattaatcaaagttgtacaaaaactagttttcaaaatatattttataatgatacaaagaaccacttaaaaatattttgccatacagattatataaaattatgcaatttttcatatttttgcaaaattatgtctacatgaatgcttcctctatcagttaccacaacccaaaattcacaaacctttaatgaaaatagagaagagaatgtaaactgtataaatcttaaaaacagaaaaaaatgacatctacagctctttgagagatcttaaatctgctgattctttattctgttcaaggcctactgaggctgatggccataccaactgttaggaagacaagagttacaaacccactgtcttctaaaatctaacatttctttagtttttaagtattttagaagtgagaagttacacatgtaaatatggtattagaactcttgcaattattctctaaatatgtaaaattgtcacagtgataaagaacctagtttaatcacattttcccttcaataaattaaaaattcttttctagttcctattaatataaacacagacttagaaaatataggtaagaaagtcataataagagacacaaatttataactaaatctatcaaataaagtttagaatctgttctatttttcctctgtttataaatcatggtaaaaattatttagcctaccaagattgaagaagctaatttagcttatgaacaaaaaatttaatatcatagaaaatagtgcaaaaaggtttaagatatagaaatacaaaaggaaatcagagaaaataaattcaagaggcctaataagggacttacaatttctggaaagataaaatataacacacaaaaaaaggaaattcatcttaaaagaaataaatatgaaaagatttgtcagagccaaaaaaatatatagaagatccaaatcttcaaattaaggagcttaataaatgtcaagcaagaaaaatggaaaaaaggtacataataaaaaaattctaaacattgaggacaaagagatgataatgaaagaaaacatcagccataaagaagtaaaaagagtcagatgaaaattcaacttctcatcagtagcactggatgctagaatacagtgaagcaaaattcttgggaggaacaatcttcaccaaacatatggtaactaaccacactatcaatccagtgcaatttaaagacattttcaaatatgcaagaacttgtgatatttatctctcatgcacttgtcactagttaccactacaatcattttgagaattatgactaggaaaagaaattctaacagaagagaaaggatgattaagagcttagaaaaactttagacatgagacatgatatggacccacaatgtaagaaaaaacaaacaggaacctcaagggaaaataaatcacccaaatcaatttttaaattatatttttatatatacatatatacacacacacatatacatgtatacatacatacaaataccagaaaacttttcctctgagtattagatgagttggtcctggaagccgagataagaaagtgtaatcacagcccactaagtgtctctgtagtgagttacggttttcaacttttagaagcaacctacagataaaattgagactgcagatgagaatgtaaacataatcaacgctcacaaagcaaaaagtaaaaataaaactattaaagatgggtattagaaacggcagaggaaagactgaagaaaggacaggtacaatctcagccatgtcttactcatctcaaaatgggttggggtcaaaagatatgatgcatgggtgacaaaaccaggaagagcaagtgtgaccagtggagaaataagagcagtaataccactatggtactatgagatactgtggtatctgcaggaaattgtgtacatgagctaaatccttaggtactaaagtagtgtatgaataaatatattattgcaaacatgctatttagatatacagtggtaactccctgaagaattaaaatcagaggtaaaactgtctcagtgaatggagagggacagtgaatttcactataagctctattagcttttttttaaccatatgtatttattacttgaaaaaaaaatttcttctaaaaagttcaattagtgcattcaaaatattcttgaactgctcaaaagaaaaccgagtaatctgaaataggcacatattacataaaaattattttattttttatttaactaagcattaagcctgaatccccattctctacacttattaagagagctttataatggagccaagcccaggatatgcacaaaggatggccaggctcaggctttcacagataactaatggttcaagggccagaacaatgaagtctttcatgcacacactaggctctgctccatacatccatcagtaattgatggggttatcttctagcatagtggggaaattagagcaatcaggtctaattgctctgtctcaagacttctgtatcatgactagccttgccctcaggtgagttctggggctgccagatcgtctgctgaattgccagagagagctgagaaggaaagtaagaaagctcttcaaatcaccagaatgccattacaaatacatttacaaagaaaactgcaaattaattatgtcatatcaagctccaattaatttgaaaacatctttatcaagaatgcaataaatcagaatactaattttaaaatgcatattatactcctagtgtcagtgctaatatacccattagctataattgaaaaggtactagaagcaaagtaagaataacatttaagaagatataatattttcaaggagaaaaatgaattattgtcatatataacaaaaatgctataatccaaagactgtaaaaatgaccctaaatacattagaaatccaaaactacatgtaaaatatgaatatcattacaatgatatcagtttaccaagtactcattgtcttctggaaatactcatgatgcttcataacaaacaaaagataaaaataatacatattaatcatatcaaatatcaaaataatatataactataaatgagctgactatttaaaacatatacacagacaattactagctttgttcactcacaggacatagaagcaatgacaccccaggaacaatgaatacatctagaacgcagatcttggtttctaaataccattctccatgaaaagaaatcagagcccttggagcaaatatctgattccaggatggagctggacagtctagaacactttgctgtaccagaagtaaggaaatggctcaaatattgataaagacacaagaaccattatgaagaaatttcccctggccaaagcaagaatgatttgaacattgaaacaaataatgatagaaacagattatagcccattaaacaaacttaagaatcttcaatccatgctggtgtaaataagtgaatcactaaataagcaaggaagaatgaaaagttcttccttacagtagcatgtaataaacatagaaagaaatgatggagttaggaaatcatttggcaacaattctgtaataactgtttcaggtaagaatcatgaatggaatttaaaactaggaaaacagtgtggagatttcttaaagaactaaaagtagaactaccagtgggattcagcaatcccactactgggtatctacccagaggaaaagaagtcattatacaaaaaagatacttgcacacacatgtttatagcagcacaatttgcaattgcaaaaatgtagaaccaattcaaatgcccatccaccaatgagtggataaactggtgtgtgtggtatcacacacacacacacacacacacacacacacacacacacacacactatggaatactactcagccataaaaaggaatgaattaatggtattcgcagtgatctggatgagattggagactattattctaagtgaagtaagtcaggaatggaaaaccaaacatcaaatgttctcactcataagcgggagctatgctatgaggatgcaagggcttaagaatgacacaacggactttggggacttgagggaaaagggtgggaaggggtgagggataaaagatacaaactgtgtgcagtgtatactgctgaggtgatgggtacaccaaaatctcacaaatcaccactaaagaacttactcatgtaatcaaacaccacctgttccccaataacctatgggggaaaaaaaagtaaaacaaaacaaaacaaaaaactagtgaaagaaagtttgatgagaaacagatatttacagtctcagagcacctccttccaaaagaaaaaactgtaactttacaaaggacaaaacaggcagattctatctttactaagtaatcaaagttagtatcaccaacaatgggaaagagagatataatatctcttgacatgttgcactgagaacccatcacttctatggtttttctgccaaaaatgcgtaactcaaatctaaacctggggaaaaggacaaatctaattgaagtatattacaacaaataagtagcctgcattcttcaaaaatgttaagatcataaatatttaaaattttgaaactatttcagatgaacgaaagcaaatatgtaagacaagtatatgcaatgtgtattcctgagctggatcttggatccaggattggatttttttttcttttttttctattaaaaacagcagtgggacaactgaaaatccttgagtaatctcctaattatgataattattattgtgattatgtaagaggatatccttatttttaggaaatccacacttaagtgttcagaggaaaagaagcattatgtctacaactctccaatagtttagaaagaagacactagacagagctgaagtaaatgtgtaaaataacatttggggaatctgggtgaagagtacataaaaattgtattgtttctacaaatttcctataaatctaagttttttcaaaataaagtttaaaaagtctgtgtaccaattcaaagtcctgtcacaaacatggaaagcaactagagcatgaacaagtttatttaaatcacaaactgacaacccattatgttatttaagtgcatgaaattaccctttacatttaaatgtgagatcattttcaagtggaaagaactgaaatattattaaaattatgcataagctaccatcatcatacataacatgattataacaatgtttcctgggtacatgtcatcccctgtaggccataagcccaagaatactaaattggattatctgtgaatctccaatatttagacactcaacaaatgtttacagaaatgaactgagaaaattacatcaataatccatctctaatcaatagatttcttgttataatcaactctaaaattggttgttaaagtttcagggatacggatttctgacactagtcttcaaactaaacccagttatgaaaccatccacattcaggagtcttaactcctagtcagactgtgggaaactggtctgaaaaacactggacagttgggagccacaatacagtttcgtgtcaactgaatattggctctgttttctcttcttggcagagaatgtagtatgcagggtttttgtttttagagacagggttttgttctgtcacccaggctgcagcacagtgacacaatcatagcttactgtggcctcaaactcctgggctcaagcaatcctcctgcctcagtctcctgagtagctagggactacaggtgcatgccaccattccaggccaatttttaaaattttttttagagatggggtctcactatgttgcccaggctagtctcaaactcctgggctcaagtgatcctctcacctcagcctccccaagtgttgggattacaggcatgagccaccacacccagctgggatgtagctttgaatgaggctgagtttgactcaagaacaagaccaatgtttgtaaatatccctctgaaaagttagtgtcctgaatataaaagagctgtgacacaccaaagactgacacagcaggaactgggttctcatatccagcaggggcctggtatcaaggcccctggtaggagtgctagatgtcaagggaagacaggccgagatacttcatctgctcctcctcttggtgaccaccccacttccagtatgcttctgcatccacagaaaaataaaaggggacttatgctatgaaaattaaggctttatttctaactgtatttacttatgatattaagaccaaaaggataactcaaatgttttgcacattttaatgaatcagtcaagacagatggagcacttactttctctgtggtaggggttgggagaaacattttttaaaatataaaaaatgtagtcctgtcagaaacaaacattctacacaggaagattaagttaaatggtaagaaataatgcaaatatggaaaataacctaatttagtggtaagacattaaatgttagtgtctttaaaaggaagattaaaatgggaattgcagtggttggtaaaattatttaatactttaaaaaaataaattgttttaaattatttacttcctatcttgtccgagaaaagatttaaggcccattacaaggaaaggtaaattgtaacatgatagtaaatgcatatcaggaataaaagaaagaaaaaagccagagatatggaaaaagtgcaaccatgaataaagcttagaaggtaagctgggtgtggcagcatgtgcctggggtcccagctactcaggaggctgaggcaagcgtatcacttgagcccaggaactcaaggccagcctggacaacacagtgagaccccatctttttttttttttaagtacatacagaaaaagtcacaattgataaaagggctctactttctggcatctaacaataaaagggaaactcagctataatattattcataattcatatatgcatattattactattcacaagtacaacaattctatgtcatgacatgaagtaggaatttatgctactgtgcagaggaaggagaggaaaaggagtagtaattataaagagaatgcttcagaaagcctatgaaacaagagcactagcgggcattaatttagactgcaggcaggaaaacaaagtgcaaagcaatagaagcaattctctttgttaaaaaaaaaaaatcaaatatttacctcaaccaaaataaaattttaacaaagctcctaaacatgctgtttcatgctatatcctccacaacactatgaaagggacactaaaataagtaaatgaaacattttgttgaataagattattattcataattctaccaaagactgtttgaattttaaaatactggctatgtggcccctttttcatggttgcaaaggaccatgtgccccactagctgcacccagagacaaccatcttgtttccttcttgcagaagctgtttctactttggaatttcagaccccactaaactttcttaaaattggatgacagatatactgagttaactattttcactgccaaggaaggacacttacacaaacaaaaataaccaaaaaaaaaaaaagactgaaaagagaggaagaaaatctgagtttattaaaaagcatacaagattgtccttatttatctaatttttcctaagactagcaaaagttgtaatcaactattgtttgggacagcagtggctctccaactttttttattttggccaacttagcaaggccaaaactccaaaagctaacttaaatcactattttccactttttagtagaaaaggatttccatgatgaagactggagaataacaaaaccaataaactgcagtaagcatgccaccagcaacaaacaggaactttactatttaatttctaagagaaaaatatgaacagctacatacggttctgtattacaacataatgtcccaggaactttaatatactctgcctttatacttatttcaataattaaaaattcattggtagtacatcaccaagtatatccatgtacatgggtcactagtttaacaatgggagtagagattatttgtatttgagccaaaaacaacatgttttaaaatgtagtctccggataacaggtaccaaaactactacactattaatataactattaatcctgcatattccctccagttttgtctcctggttttattacaacatggaaagtagataagcagccattatcagaaggcaatgttaaagaaattacgagcaaattacaagcctgggatttacaatgactggtagggttaccctgggtttgtaaagtttggagaggtaagccttccaagagttaaatgctacctgggccttgacaaccacctggattcatgcttcgggtcatgtgcggaaacttgcccttgctacggttcagcttgtttcactaactcctctaagagtatagtctaattaaaacttaaaaataaaccttagatttatacaggattttgaggagtgaggtgtagcaatatgataaatatatccctataaggtgaaaatatatggataggtaaaaggacagaaacagcacatcttatatccccaataagtgtacttttgtatcttccaaattacctaaaactgcagcaacatggatggaggtggaggccattatctaagtgaactaactcaaaaatagaaaatcaaatattgcgtgttctcacgtataagtgggagctaaccaatgaatacacatggacataaagacagacataacagacactgagactcccaaggagggagtgggggaggcggctgaggttataaattacctaactgggtacaatgttcaatatttgggtaatgagtacacgagaaccccaatccccaccaccattacgcaatatacttatgtaacaaacatgtacatatatcccatgaagctagaatttttttaatgtaagctataaaaatgttaggtaaccatttactgatgtgatattcagaacatgaaaaagaaagttaacccaacagaaaacaaagcaagatacactataacccgcactgtgcactaacctagaaaaggaaaaaaagatgttaacatcaacacatatttaactatctacaaatttgtttattattactaaattagagaagtaatacagcaaagtgggtaagagactgcctagactcaaagcaaaggcgtaccactgactagctgtgtgatttaggacaaactatttaaactctctatgcaaaagttcctaagcttagaaaataaggatagtaacagttcacaactcaaacaattatacaagttactatgtcttacatttctagaagggtgcctaaaacatagtaaacatatgttaactattattatttgctttaaattattgtgaacactatagagaagaatttttaagtctggtcggcataagaacaaattctacgttctattttaagaggcccttgctgtcttgtatatagtttcatcaataatgaaatatactacttatactgaaaatttatcaccaattaatttgaaacatctactaggttgataattgtttaaaatcacccacctgccaagtataatcctttataatttctgtaggcattggaattacaaggagattctgaagaataaatgccgcctgaaaatgtaaaaaaaaaaaaaaaaaaaaaaaaaaaaaaaaaaaaaaaggtcaatactgccatcttgtggtcatctctgaaataaccaatatattgtaattaatagcaaaagacatctctggtcaactgcacatgctgagaggtcattatgagaattgtcaaactgtatttcttgttaggtgatgaccttcttaggtaatgaccttgttaggtaatgacctaacagcatatgaaattatttcatcaggaaatatatcttttcctatttcagaattcagctttattaaaaaatgatttgtataacataaattcttctggtagcatttaagaaatataattttaggtttctactatcccctttcagattacacacacacacacacacaaacacacgcacccctctgccccgctttctcccttctcttatacagactcctttcaataaaaacttgctaactagaaatacaaaccacaaatgtccaacttgactagatcctgaagatgatcaaattaaataatcatacaaataggagcattgattgtctgcttaatgaaagatgaaataaccataatgggagaatgacaggattaacaagaggattctaagaaactgacatttccaaccatgataactagaagtgatggaaaagctttaaagttgataaatcaagaagcagccataaatataaacatcactacttaaaaacatgaaggcaaacagcaacaaaactagccttttgagcttggaactggcgactgctaatggtggacccaggagctgctgttttttttcataagcctctaagtacaatttgattattgttttaaaaccatttacatgaatcattactttaacaaaagcagcaataaaaaaaaaccacaagctattcagaaagaattaaaatagggtttatttttccctctcatgttatatgataaatactacaaagagttattttgacagcctcttatctatactaaagcttcataaatatcagagacccataaatgctgagataatataaaagtaatttttcctgtgaactacctttcaatgcataataaaaaaagttcacattaaaatatagtatattccgattttatcttatcggaaggaaggactccagtttttcctgtgcatgaataccttttaaatcctctactgtcattttgtttgggtgttcacagacagaagagatcatggtcagtggtcagtccaccatgttgagcggcagtcaagtatcgcttacggataccatcacaaagaatttctaaggaaaaaaaggagaaaagacagacatacctcccggcgcaccatactacattctgactggtccagaagaatgttcaccacagttccccagagcccaccggaaatgttctgacaactgtttgctaaggccacacagcccgtttcaagggtggtcagtgctgatcctaatcccagtgaagtgaatctcacctgttcaaattaaagagaaagttgttgaatcaaataagcctttttcctaacatgaattcttagtttttctggtacataaatatcacactttaaaaaaatccattggttttatgatcctaaattataagagacacctatagaagacagtgtcctccattccatgattcaagaaagcagtaatataggaaaaattaaatataagcaaatttcaaagcaaagtaaaactgggtataaaaagatgcataaaaattatagtttgcaagcctttttctaaggaaagcatagggcacttacattttatgaacacaatttcaattcttcattcttaaaaaaggtagctattctttgttctacctttcttaattttttattgtttcttccaaataaatgattttaactttcttaaaacttctaaacaaagaggcaattatcattttacaaggcatttcgtattttcctcaaaagttattcaagagaaaaacgttcccaaataagattgatgtggtataatatgcttgctgtagaaccactgctgttcaagccacacgttttggtaaatttctgaattcgaatccaaaaatatagtttcaatgacagctatagaattttttaaaaatgcagtcataaaattgtcaagtagtaagtccaagttcaatgtgactaaaaaatgtatttcaaatatttctataaataagattttattgtaatagcatattttacttgaaaaaagtaaactggctaaaactggaaagaaataatacaaaattttgtattgtaatgcaaatgcaattttttgcatttaatttaatttcattatatgacacttaagtgttgcatgtctataatttccagatcctttttatttttttcaaaattgctaagcttctccaataattttccactcttctgaaggtaatagatactataaccttttctcttttatattttcaatctatactcgaacaaatttgattgaaaatgagggtgctgtgtactgaactgtgtctcctcaagactcgtatgttgaagccctaatccccaacctgtatttggagacagagctattaggtgattacagttaaatgaggttataagggtgggaccctactgcactaggaatggtggcctcaggaaggagagaaatctttctccatgtgcgtgctccaaggagaggtcatatgagcacacagtgagaaggtggccctctgtaaatcaggaagagtgccctaccagaaaccaaccatgttgacactctgatcttggacttgcagcctctataactgtaagaaataaatttctgtttttaagccacccagacaatggtattttgttatggaagcctgagcacactaatacagatttttgtaccaaggagtggggatgctgctgaaacaaatgcctaaacacatgaaagtgactttggcactgggtaatgggttacaggctagaagagttttgaggtggatgccagaaacgtagacatgggtaattctcatgagatctcagacaaaaatgaggaaagtgttatttaaaaaaggttatttgaggaaaggcaatccttgttataaagtagcaagaaaactggttaagctgtggtcatgttctagtgttttgtgaaaggcagaacttgtgagcaatgaaattggatatttagctgagaagatttctaagcaaagtgttgaaaaattggcttggttcctcctgattgcttatagcaaaatgcaaagggagagagatgaattaaagaaggaattaagaatgggtaagcaaaaagaaacaagaacaagatttgaaaaattctcagcctatctgtgcaaaaaaaatgagaaagcttgttctaaagagaacatggagggtgtggctgaatacccatttaagaaaaagatcacgggtgcaattcatggacttaatcagacatctcagcagaagccaggaatagagatgggattatatcagcaaagacattgccagtttgaactaaagaggacagagaaagatgcagagaatgaaggaaagctgttggacttcctggattctgtaagcaaatatgtgctacagtggtccctcccttatccatggggaatacattccaagacccccagtagatgcctgaaaccacagatagtgctgagccctataactactatgttttctcctacacatacatatctatggtaaagtttacaaattaggcacagtaagagattaacaataactaaaaataaactagaacaattacaacaatatgttataatacaaaatacataaatgtggtctctctctcaaaatatcttattgtattgcactcagccttcttgtattgatgtgagatgatacaatgattacataaagagatgaggtgaggtgaatgatgtaggcattgtgagggagggtttggctactactgatcttcagggtgcttttggaaaatgaaacctctgataagggaggactactgtattcttcaatgaaaagaatgacccaaaaaatgattcagagatccccaggctgctaatcccaccacaggactcaagggtggcttttcctccttggtttcaaagacctctgatttctgtgggccagaatgatgaccctgcccagtgcttcaggaacatggctgcccttgaagacagctttatgggcggggctcttgaagacagccaaaggggtggggtcatcccacagagccatctagacagatgctgtcactctggtgggcctgtaaggcacaccatcaagccaaagaacattatccttgagcattaacatctaatgaaatttgctttgctaggctttggacttgcttgggacccatcacttcttcctttttttcctatttctctcttttggaatgggaatgtctattctaccatcatcttttggaagcatataacttgtatgggttcacaggttcacacctgcagaagaattctgtttcaggagggtttatatctggagacttacccagatgtggtttaaatgacatttagatgagattttggactttagactttacagttgatttgggaataagttaagacttttgaggttgttgagggagaataaaagcattttgcatggaagaagaacatgaagttcaggggctcagggatggaaaactatgaactgaattgcgtccctccaaaactcatatgttgaagtctttatgctcaagtgactacatttgaagacagggtttctaggagataattaaggtttaaagagatcataagggagtggtcctatctcaataagactggtaacattataataaaaaaaaaaagacaaatctgtctctataccacccctccctcccctgccccacatgcatggaccaaggaaaggccacgtgaatacacagcaagaaggcagccgtctacaagccagaagaagagccctcaccagaacttgactatgccggcactctgatcttggactttcagcttccaaaacttctatgagaaaagaagtgtctgttgtctaagccacccagtctgtggtattttgttatggcagcctaagctaaaacagggcttaaataaaacataaggtagagtcactacaataatcccataatataactatgtatatgtatatatgttttgtgtcttttttttttttttgagatggagtcttgctctgttgcccaggctggagtgcagtggcacaatctcagctcactgcaagcttcacctcccaagttcacagcattctcctgctgcagcctcccaagtagctgggactacaggtgcctgccaccacacccagctaatttttttatatttttagtagagatggggtttcactgtgttagccaggatggtctcaatctcctgacctcgtgatctgcccacctcagcctcccaacaagctgggattacaggcatgagccaccgcacctggccccgtgtcatttgttttttaatctaaacacaatacacttgattctccttcacactcacctctgggtcccgatcaacccataatggaatcaaccaagccaatccttgttgagtaggaatatgttcttcactatgactacccaaaggcaagaaccaaagtgacatccactcctagagggaaaaaagggaaacagaaatatttgaggtaagtttctaaaaataaaatgcaggaaggttaaaacaagaatttttaatgaaaacaacgtgaaaatgtattttagacttggttttaatccattattcagccaaaaaaggcaaacaaaaaaatttgtttctctttaaaaagttaaacataacaattttttgacagaagctatttttcccataatgtagacaaaatgtagttttccagtgtatgcacatttgaatcaatttcaaataagattcagatttgttaatatacaacttctaagaaatattctagtcaaaaatcattcacgttacctaaaaagaaaagtcaaaagagacattttcatgtggcaagtttatatgcttgaaatgtgttggacacagcacattccctttcaagcaaatgttcagaagatagacagctttaacgcgctcaccaagctcccagcctgggccatcatctcatgggataagtgaagcaagcaaagaattgtgctctttgtaacaccttttcccatgaaggacatagcatttcctccacgctccacataaaaagaagtaatgacctgaaaaacaaatgtaaacaatttcatggtggctttattctcaatggtatataaagataaatatataactgtctactgacttgtatgaattgaatccttaccttataaagttgtaatatttttagtttatatacttaaaaatgaataagatggtaaattttatgttatgggtattttaccattgttaaaagaaaatattcttcagcctacataacatagcaagacccagtctactttaaaaaagaaaaaaattagccaggcatggcagtggacacctgtagtcccagctaccggggaagctgaggagggaggatcccttgagcctgggagctggagcttgcggtgagctatgattgcaccactgcacttggcctaagttacagagtgagatcctgtaatttttcaaaacaaaaacaaaaattcttagtttcaatatttttccttttaaagtctgtaaaaaaaaaaaaaaagatgtgtggtgccctcctagtacacagttgtaacttagaatatgcttataatatttttaaaaatgttatagcatccttttaaagagtttatgaataatttgtgctggttttcaaggggaatgcttccagcttttgctcattcagtatgatattggctgtgggtttgtcacaaataggtcttattattttgagatatgtctcatcaatacctagtttattgagaatttttagcatgaagagatgttgaattttatcgaaagacttttctgcatctattgagataatcatgtggtttttctcactggttctgtttatgtgatggattacatttattgatttgcatatgttgaacgggccttgcatcccagggatgaagccaacttgatcatggtggataagctttttgatgtgctgctggattcggtttgccagtcttttattgaggattttgcattgatgttcctcagtgataatgacctgaaattttctttttttgttgtgtctctgccagattttggtatcaggatgatgctggcctcataaaatgagttacggaggattccctcttttctatcatttggaatagtttcagaaggaatggtaccagatcctctttgtacctctagtagaattcggctatgaatccctctggtccttttcttggttgctaggctattaattattgcctcaatttcagagcctgttattggtctattcaggaattcaacttcttcctggtttagtcttgggagggtgtatgtgtccaggaatttatccatttcttctagattttctagtttatttgcgtagaggtgtttataacactctctgacggtagtttggatttctgtgggatcagtgctgatctcccttttatcattttttattgtgtctatttgattcttctctcttttcttctttattagtcaggctagtggtctatctattttgttgatcttttccaaaacaccagctcctggattcattgattttttttgaagggttttttgtgtctcttgtcgccttcagttctgctctgatcttagttatttcttgtcttctgctagcttttgaatttgtttgccattgcttctctagttcttctaattgtgatgttagggtgtcgattttagatctttcccccttcctcctgtgggcatttggtgaaacactgctttagctgtgtcccagagattctggtatattgtgtctttgttctctttggtttcaaagaactaatttatttctgccttaattgtgttatttacccagtagtcattcaggagcaggttgttcagtttccatgtagttgtgcggtttgtagttagtttctcaatgctgacttctaatttgattccactgtggtctgaggggctgtttgttatgatttccattcttttgagtttgctgaggagtgttttacttccaattatgtggtcaattttagaataagtgcgatgtggtgctgagaagaatgtatattctgttgatttggggtggagagttctgtagatgtctattaggtccgcttggtccagagctgagttcaactcttgaatatccctttttttttttctgaatatcctttttaattttcagtctcgttgatctaatattgacagtgaggtgttaaagtctcccactgttattgtgtggaaatctaagtctctttgtaggtctctaagaacttgctttacgaatctgggtgctcctgtattgggtgcatatatatttaggacagttagctcttcttgctgcattgatccctttatcattatgtaatgccttgtttttttttttatctttgttggtttaaaatctgttttatcagtgatgaaaattgcaactcctgcttttttttttctttccatttgcttggtaaatcatcctccatccctttatttcaaacttatgtgtgtcttgcatgtgagatgggtctcctgaatacagcacactgataggtcttgcctctttatccaatttgccagtctgtgtcttttaattggggcatttagcctgtttacatttaagattaatattgttatgtgtgaattgatcctgtcattacgatgttagctggttattttgcccattagttgacgcagtttcttcatagcatcaatggtctttataatttggtatgcttttgtagtggttggtactggttgttcctttccatatttagtgctttcttcaggagctcttgtaaggcaggcctggtggtgacaaaatctctcagcatttgcttgtctgtaaaggattttctccttcgcttttgaagcttagtttggctagatatgaaattctgggttgaaaattattttctttattaatgaatataggcccccactctcttctggcttgcagggtgtctgagagagatccgctggtaagactaacagggatgggcttccctttgtgggtaacccgacctctctggctgcccttaatatattttccttcatttcagccttggtaaatctgacgattacatgtcttggggttgctcttctcggggagcatgtttgtggtgatctctgtatttcctgaattggaatgctggcctgtcttgataggttggggaagttctcctaggtaatatcctgaagagttttttccaatttggtccattctccctgtcactttcaggtacatcaatcaaacgtaggttcactcttttcacatagtcccatatttcttggaggctttgctcattcccttttgttttttttttttctctaatcttgtcttcttgctttatttcattaagttgatcttcaatctctgatatcctttcttctgattcatcgattcggctattgatactcatgtatgtgtcacgaagttctggtgctgtttttttcagctccatcaggtcatttatgttcttctctaaactggttattgtagttagcaattcctctaccctttatccaaggttattagcttccttgcattgagttagaacatgctcctttagcttggaggagtttgttattacctaccttctgaagcctacttctgtcaattcaccaaactcattctctatccagttttgttcccttgctgtcaaggagttgtgatcctttggaggaaaagaggcattctggtttttggaactttccgcatttttgcactgggttttcctcatcttcatggatttatctacctttggtctttgatgttggtgacctttggatggggtctctgagtggaagtcctttttgttggtgttgatgctattcctgtttgttagttttccttctaacagtcaggcccctctgctgctggtctgctggagttggctggaggtccactccagaccctgtttgcctgggtatcaccagcggaggctgcagaacagcaaagattgctgcctgttccttactctggaagcttcgtcccagaggggcattgccagatgccagcagagctctcctatatgaggtgtctgtcaacccctgctgggaggtgtctcccagtcaggaggcacggggttcagggaccaacttaaggaggtagtctgtcccttagcagagcttgagtgctgtgctgggagatccactgctctcttcagagccggcaggcaagaatatttaagtttgctgaagctgtgcccacagctgccccttccccaaggtcaaaaatttaaaattttaagtgactacttgaaaaataaaatatctaaatgatcagatccttattatcttcctctaagtcatctttggagatatctaacatctgtgatctgtgtaatgatttttaattctagcttataaatgacaagccaagacctttgccagtattttctttcaacttgatatttttgtcagacctctggaattatacatcatgtatctgatttaaagatttaattatcatagtttattcacctatcataattaatcatgcttagttaaaaagtctcatttcacagctacaaaaagcaaatactcatattcaaatttcactgtgcagaaacaagctaatcttttattagaaatatggctcccttccaaaaaggaaacagctttaattactaagaaactatgaagcaaatcatttggaccaacaatgactttgtttcaatgttctctcacataagccttactttattctttaaaagatgaatttagtcattagtagtacaacagggatacctgtttatgtaattaataaactaagcagatagtcccaagattaaatgttaccctgctacaatttttaacaaaagtgacggattctttcctaatatttgcctgccatttaacataaagtcataaagattttctgctcgagatgttttatgaagcacaaaacgacctcctttttaaaccaaagcaagattggctaatcaaattttttataactgcgaaacattacataacagggactgtgctttttatgtatcctttagctaacaaactgttactaaattttattacctcaaagacaactgaacacagaatggactactgcctttttgcctacacttcttacctaaaactaagcccttttgttctccaatacattaacagttcatttcaatttctggtatttgaaacgtaggtgtgatctaaagtctttgcacgtaattttaaaacaaaagcacttctgatagtttctaaacataaatgaggcaacacttcacttcttctttagttaccgctgtggcaggtcctcacctattcctgatttcaaagagtaaaactcattttctagaggagactgactctgtaaaaggttgataaatagagtatttataaatcacatgacaaaaaatgctataaactaggtacttataggttcaattatatattttttttaatttttaaacttttaggttcacgggtaacgtgaatgtttgttacacaagtaaactcatgagaacaaagttacaacacatcagaatctctgggacacagctaaggcagtgttaagagggaaattcgtagcactaaatgcctccatcaaaaagttagaaagatctcaaattaacaacttaacatcacaactgaaagaattagagcagcaataacaaatcaaccccaaactagcagaagacaagaaataaccaaaatcagagctgaactgaaggaaatcaagatatgaaaaaccattcgaaaggtcactagatccaggagttgtttttttgaaaaacttaatgagatagataggccactagctagactaactgaattatattttaaatgcactagaggagctgactttctaagaaatattatcattaactctttaatatacctgttttttaaaattcatacatttctaatagacagcagaaaataactaattagtatactgacagttgaaccttttttaatatttataattaaaaaatgaagtttattttatttttttaatatacttaaagttctagagtacatgtgcacaacgtacaggtttgttacatatgtatacatgtgccatgttggtgtgctgcacctgttaacttgtcatttatattaggtatatctcctgatgctatccctccaccctcctcctaccccatgacaggccctggtgtgtgatgttccctaccctgtttccaagtttttcattgttcaattcccacttatgagcacgaacatgcagtgttcggttatctgtccttgcgatagtttgctgagaacgatggtttccagcttcatccatgtccctacaaaggacatgaactcatcctattttatggctgcatagtattacatggtgtatatgtgccaaattttcttcacccagtctattgctgatggacatttgggctagttccatgaatatagcagcatgatttataatcctttgggtatatacccagtaatggaatggctgggtaaaatggtatttctagttctagatccttaaggaatcaccacactgtctgccacaatggttgaactagtttacagttccaccaacagtgtaaaaatgttcctatttctccacatcctctccagcacctgttgtttcctgacattttaatgttgccattctgactggtgtgagatggtttctcattgtcgttttgatttgcatttctccgatgatgagcattctttcatgtgtctgttggctgcataaatgtcttcttttgagaagtgtctgctcatatccttcgcccactttttgatggagttgtttttttcttgcaaaatttctttaagttctttatagattctggatattagccctttgtcagatgcgtagattgcaaaaattttctcccattctgtaggttgcctgttcactctgatggtagtttcttttgctatgcagaagctctttagtttaattagatcccatttgtctattttggcttttgttgccattgcttttggtattttagtcatgaagtccttgcccatgcctatgtcctgaatggtattgcctaggttttcttcttgggtttttatggttttaggtctaacatttaagtctttaatccatcttgaattaatttttgtgtaaggtgtaaggaagggatccagtttcagctttctacatatggctagccagttttcccagtaccatttactaaatacggaatgctttccccatttcttctttttgtcaggtttgtcaaagatcagatggttgtagatgtgtggtattatttctgagggctctgttctgttccattggtctatatctctgttttggtaccagtaccatgctgttttggttactgtagccttgtagtacagtttgaagtcaggtagcgtgatgcctccagctttgttctttggcttaggattgtcttggcaatgcaggctcttttttatttccatttgaactttaaagtagttttttccaattctgtgaagaaagtcattggtagcttgatgaaggtggcattgaatctataaattaccttggccagtatggccattttcatgatattgattcttcctatccacaagcatggaatgttcttccatttgtttgtgtcctcttttatttccttgagcagtggtttgcagttctccttgaagacgtccttcacatcccttgtaagttggattcctaggtattttattctctttgaagcaattgtgaatgggagttcactcatgatttagctgtttgtctgttattggtgtataggaatgcttgtgacttctgcacattgattttttgtatcctgcgactttgctgaagttgcttatcagcttaaggagattttgggctgagacgatggggttttctaaatatacaatcatgtcatctgcaaacagggacaatttgacttcctcttttcctaactgaataccctttctttctttctcctgcctgattaccctggccagaacttccaacactgttgaataggagtggtgagagagggcatccctgtcttgtgccagttttcaaagggaatgcttccagtttttgcccattcagtatgatattggctgtgggtctgtcataaatagctcttattattgcgagatacgtcccatcaatacctaatttactgagagtttttagcatgaagggctgttgaattttgtcaatggccttttctgcatctattgagataatcatgtggtttttgtctttggttctgtttatatgatgggttacgtttattgatctgtgcatgttgaaccagccttgcatcccagggatgaagcccacttgatcatggtggataagctttttcatgtgctgctggattcagtttgccagtattttattgaggatttttgcactgatgttcatcagggatatggtctaaaattctctttttttgttgtctctctgccaggctttggtatcaggatgatgctggcctcataaaatgagttagggaggattccctctttttctattgactggaatagtttcagaaggaatggtactagctcctcttcgtacctctggtagaattcagctgtgaatccatctggtcctggactttttttggttggtaggctaataattattgcctcaatttcagagcctgttattgatctattcagaaattgaacttcttcctggtttagtcttcggagggtgtatgtgtccagaaatttatccatttcttctagattttctagtttatttgcatagaggagtttatagtattgtctgatagtagtttgtatttctgtgggatcggtgttgatatcccctttatcattttttattgcatctatttgattcttctctcttttcttctttattagtcttgctagtggtgtatctattttgttgatcttttcaaaaaaccagctcctggattcaccaattttttttaagggtttttgtgtctgtacctccttcatttctgctctgttcttagttatttcttgccttctgctagcttttgaatgtgtttactcttgcttttctacttcttttaactgtgatgttagggtgtcaattttagatctttcctgctttctcctgtgggcatttagtgctataaatttccctttacacactgctttaaatgtgtcccagaaattctggtatattgtgtctttgttctcactggtttcaaagagcatctttatttctgccttcatttcgttacgtacccagtagtcattcaggagcaggttgttcagtttccatgtagttgagctgttctgagtgagtttcttaatcctgagttccagtttgattgcactgtggtttgagacacagtttatcataacttctgttctttttcatttgctgaggagtgctttaattccaactatgtggtcaattttggaataagtgtgatgtggtgctgagaagaatgtacattctgttgatttggggtggagagttctgtagatgcctattaggtccacttggtgcagagctgagttcaagtcctggatatccttgttaactttctgtctcactgatctgtctaatgttgacagtggggtgttaaagtctcccattattattgtgtggagtccaagtctctttgtaggtctctaaggacttgctttatgaatctgggtgctcctgtactgggtgcatatatatttaggatagttagctcttcttcttgaactgatccctttaccattatgtaatggccttgtctctttagatctttgttggtttaaagtctgttttatcggagagaggattgcaacccctgcctttttttgttttccatttgcttggttgatcttcctccatccctttattttgagcctatgtatgtctctgcacgtgagatgagtctcctgaatatagcacactgatgggtcttgactctttatccaacttcccagtctgtatcttttaattggagcatttagaccatttacatttaaggttaatattgttatgtgtgaattcaatcctgtcatcatgatgttagctggttattttgctcgttagttgatacagtttcttcctagcatcaatggtctttacaagttggcatgtttttgcagtggctggtaccgcttgttcctttccatgtttagtgattccttcaggagctcttgtaaggcaggcctgatggtgacaaatctctcagcatttgcttgtctgtaaaagattttatttctccttcacttatgaaacttagtttggcaggatatgaaattctgggttgaaaattcttttctttaagaatgttgagcctggctgccccgtctgggaagtgaggagcgcctctgcccgggcgccccgtctgggaagtgaggagcgcctctgcccagctgtccagtctgggaagtggggagcgcctctgcccaggcgccccgtctgggaagtgaggagcgcctctgcccagctgtcccgtctgggaagtgaggagcgcctctgcccggctgccccgtctgggatgtgaggagcgcctctgcccagccgccaccccgtctgggaagtgaggatcgcctctgcctggccgcctcgtctgggaagtgaggagcgcctctgcctggccgctgtgcaatcttccaagcatgaagtgacagcctgtctgcaggggtacccaacagctctgaagagacagcgaccatcgagaacgggccatgatgactatggcagttttgtcaaaaagaaaagggggaaatgtggggaaaagaaagagagatcagattgttactgtgtctgtgtagaaagaagtagacatagcagactccattttgttctgtactaagaaaaatttttctgccttgggatgctgttaatctataaccttacccccaaccacgtgctctctgaaacatgtgctgtgtcaactcagggttaaatggattaagggcggtgcaagatgtgctttgttaaacagatgcttgaaggcagcatgctggtcaagagtcaccaccactccctaatctcaagtacccagggacacagacactgcggaaggccacagggacctctgcctaggaaaaccagagacctttgttcaagtgtttatctgctgaccttctctccactattatcctatgaccctgccacatccccctctccgagaaacacccaagaatgatcaataaatacttcaaaaaaaaaaaaaaaagcaaatcataaaaaaaaaagaatgttgaatattggcccccactctcttctggcttatagagtttctgccgagagatccgctgttagtctgacgggcttccctttgcgtgtaacgggacctttctctctggctgcccttaatattttttctgtcatttcaactttggtgaatccgacaattatgtgccttggagttgctcttctcaaggagtatctttgtggcgttctctgtatttcctgaatttgaatgttggcctgccttgctaggttggggaagttctcctggataatatcctgaagagcgttttccaacttggttccattctccccgtcactttcaggtacaacaatcaaatgtagatttggtcttttcacatagtcccgtatttcttggaggctttgtttgtttctttttattcttttttctctaaacttctcttctcgcttcatttcattcatttgatcttcaatcactgataccctttcttccacttgatcaaatcagctactgaagcttgtgcatatgtcatgtagttcttgtgccatgattttcagctccatcaggtcatttaaggtcttctctatactgtttattctagttagccattcgtctaatctttcttcaaggtttttagcttctttgtgatgggttcgaacatcctcctttagcttggagaagtttgttattaccaatcttctgaagccttcttctctcaactcgtcaaagtcattctccgtccagctttgttccgttgctgacaaggagctgtgttcctctgcaggagaagaggtgctctgatttttagaattttcagcttttctgctctgttttttccccatctttgtggttttatctatctttggtctttgatgatggtgacgtacagatggggttttggtgtggatgtcctttctgtttgttagttttccttctaacagtcaggaccctcagctgcaggtctgctggagtttgctggaggtccactccagaccctgtttgcctgggtatcaccagcggaggctgcagaagagcaaatgttacagaacagcaaatgttgctgcctgatccttcctctggaagcttcgtctcaagaggggcacccggctgtatgaggtgtcagttggcccctactgggaagtgtctcccagttaggctactcgggggttggggacccacttgaggaggctgtctgtctgttctcagatctcaaactctgtaacgggagaaccagtactctcttcaaagctgtcagacagggacgtttaagtctacagaggtttctgctgccttttgttcagctatgccctgcccccagaagtggagtctacagaggcaggcaggcctccttcagctgtggtgggttccacccagttcgagcttcccggccgctttgattacctactcaagcctcagcaatggcggacacccctcccccagcctcgctgccaccttgcagttcgatctcagactgctgtgctagcagtgagcgaggctctataggcgtgggaccctccaagccaggcgtgggatataatctcctagtgtattgtttgctaagaccattggaaaagcacagtattagggtggaagtgtcccaattttccaggtaccatgtgtcacggcttcccttggcttggaaaaggaattccctgacctcttacgcttcctgggtgaggcgatgccccgccctgcttctgctcacagtccgtgggctgcacccactgtccgacaagccccagtgagatgaacccggtacctcagctggaaatgcaaaaatcacccgtcttctgcgtcgctcatgctgggagctgtagactagagctgttcctatttggccatcttggaacctctccgaaatttattttattaaagggactccagtgaaattcatattaaattttacagtacagcaaagagtatttatgatctttaaacttgttttaaaaacaatatgtgcttttggaaaaaagttctagataagaccagataaaatatatatatacattatttaaatcattatttagtaataaaaatacaacaataaaacatatttttataatcatttatgctacatttccaaaatgtttttcaaactgtatcttaatttaaaaactatacacaatatatatgtattatgtagcacatatattaattaactgattcactaaccactatgtaaaaaccatggtgctaggtcaatgcagtagccatgggatagtagaaatagcccaaagatgatacttataagctcatagtctactagagcaatgcagaaaacaaaataaaggtccagttacagtggctcatgcctgtaatagcagcactttggtaggccaaagtgggaagatcatttgcgccaaagaattcaagacaaacctgggcaacatagtgagacccatctctacaaaaaaattaaaccagccaggtgtagtggtgcacacctgtggccccagctacttgggaggctgaggtgggaagatcacttgggctcaggaggttgaggctgtagtgagctgtgattgcaccactgcattccagcctgagcaacacggtaaaccctgtctcaaagaaataaagtaaaataaataaaaatataatgtattaagtaatagccacatatataaattgttacaggtatataacctacaggaaaggccaaacagtattaggtaagtatccaaccttggaagaataagaaaaggtttactaaatgaaggtaaataaataagttagatcttaaattttttgtagatattgccatccctaaaagagaggaaactatgtgaaagaagcagtctttttaaagtgcatttttattttggaaaaacagccagatataactgaaaattcagagatgtgggaaaaaactacaatggaggcaaatctctaaatgcaaaatattgagtcttatgctcttgaaaaaaaaagaggtttggattgaaaaatttatgtttctgaaaaataatctggcaataggtagagattatatgatgtcaagaagtcacccacagcatgaaaaaaaaacaggaggttatagatacaattttatcagaaaattccatgtctagaatgtctattgctatcactatcaatttacttatctttcaaaatctaactctacagtgcttcctacaagaatcattcttgaggtccgaacacagttagcaatcaaaacaaggctgacagatttgtccagtaagaaaacaatgagtaatttttggattcagacagtttattacctacataaacagcaaaagcaagaatagacaaaggtgccagctactagtatcccttgcacaggatgacattgaaacaaaggggccagatgactataacaaagatgtaggacactctgttgcggagaagcccatgccgtgctgcagtaaagcagttttataagctgtagctatgccccaaggagagcaaggcagaaagcccagtgctcgtcggaacctaggaaccaataagaaacgggctcctaactgacttcctaatagactgtgaagtaagtgagaatcaatcttgcatagtcagctgctcataagcctttcatattctcatgttccagaaggatcacaggaaattctgccaagatttagattggctgtagttaagccttgtctatgaagcccaagggcagatatgcaaaattgtcaggccactgtgatgaggctgttctcatagaactatgtacaaccatatcattgtcgtatttattatatcacagtagaaatattttgacctaaattgatgataaaaacatggcataaggccatgcttagaggattagagctaaaaacacacatttgagaaagacttttaaaaaaatcaatgacgtaagcctctaccttaaaatgttagaaaaaagagctgtaaactaaactaaaagtagaaggagataataaatattggcagaaataaaacaggagaaaaaagttaaagagaggctcaacaaagccaaaggttcattctattagaaagataaaccaagaaaaattgagaaaggaataattaatgtctgcaatgaaaggggacctcactacagattcagcagacattaaaagtgtaagatgatttgatgaataccttcacagtaacaaattttaaaaattagataaaaagtttttaagttctacaaaaacataacttactaaggctgacacacataaaaagaaactctgaacgattttagatctatttaaaaagtcatttcaggccaggcgcagtggctcacacccgtaatcccagcactttgggaggccaagacgggtgtggatcacctgagatcaggagttcgacaccagcctggccaacctggtgaaaccctgtctctactaaaaagacaaaaattagctgtgcgtggtggcaggcgcctgtaatcccagctacttgggaggctgaggcaggagaatcacttgaacccgggaggcagaggttgcagtgagctgagatcatgccattgcactccagcctgggcaacagagcaagactctgtctcaaaaaaaaaaaaagtcatttcatttcacaatttacaatcttcccaaaaagaaaactgcaaaccaagattgtttcacgatcaaattctacctaacattagagaacaaaatcacaccaatgcaaatcagctattccaaaaaagaaagttatataaaggaaaagatttaaaatggttgaaaaagtcacgttcttacaatctcacattctcccattttagtcataagaacggaatgattttgattattaaaaacctgacaaattctttaagagaaaaaagatgcaaaattcgaaaaacttttttacatgaggaaatagaataattctaaaaacttcagaattctaaaaaattgagaaacgaaatccactaacatataaaaagagtaatacatcacaacctaactgaaatgtttcgagaaatgcaaggttgtttaacattttaaaatcaatcagtaatggaatataagggaaaaatcatgtgattatcttaaaagatacagaaaaaagcaatatacaattatgaattaaaaaacaaagctcctagcaaaacaggacaaaagaaaacttccttaacttgatctttcttaattgacaaaaaaaaactataaacagcatactgaagggtgaaaaattaaaggcttttgttttgatattggaaataagaattgcctgatacatggtcaacatataaaaattggctatatttacatatttcaataacagaagataaaatttcaaaaaagatgctcattttcaccaaaagataagaatgttcatagcagtagcatctagaactgcacaaactggaagaaaaagaaaaaacaaatatcctttaacattgtacagcctgagtatgccgtatacaaaatgcttgggaccagaagtgtttgaattttggagttgtttggattttgaaatacctgtatcatatacttactggttgagcattcctaatccaaaaatccaaaatctgaaatgctctagcgaacacttcctttgagcatcaaaagtttccatttatttcttttgaaaatgagggtatttataaaagtgaccttccttacttaactattaataaaaatcactaaaacatttcactattatgacttatataaataatgtataatattctacattgaatagagtaacgtataatgcacttgtggcctggcataaagtaaaagcaactaatagtaaataactaccatatgctatttttacttacctcaaggagacctgacaagtacttcacacagatatctagaggctttgtgagaggagagtgtgagctccatcccggaaacgcagtgaggttagccatccctcgtaaggtccgctcaagggacggcaggccatagaaatgaggcgcatccgtcactttcagacactggagcagtttcagagccagctgcgtttgaaaaacgtaaagaagttccgagcatttcctatgtatgcaaaagagggaaaatcaaccaccaagaaagtataatgggcttaatgggctatcttactggctataaaaggttacttaaactcatagtaatagaaaaaaatgaaccagacaaaatggcagaaaatagtctctatcaaaatgagacttttcaaggaaagcataaaataccaactagagaatgtcatataaaatacaagtaacgattacactgggccaggggctgtggctcacccctataatcccagtgccttgggagcctgaggtgggaggattgcttgcggccagcttgagcaacacaacacagtgagacctcatttctaaaaaaatgaaataaaataaaattaaagtaaaaaaaattagccaggtgtggtggtgcacacctatagtcccagctactcaggaagctgaggcaggaggatctcttaagccctggagcttgaggttacagtgaactaagaatgtgtcactgcactccagccggggtgacatagtgagacccccatccctttttaaaaaaaaaaaaaaaaaggttggggggattgctggcaagatggtcaaataggaatagctccagtctgcagctcccggcaagatcgacgcagaaggcgggtgatttctgcatttccaactaaggtacccggttcatctcactgggactggttggacagtgggtgcagggcacagagggcaagctgaagcagggtggagcatcgcctcacctgggaagcgcaaggggtcggggaattttctccaccacccaagggaagccgtgacagactgagcctgaggaactcctgcacagatactgcgcttgtcccacggttttcgcaacctacaaaccaggagattccctcggttgcctaccctaccagagccctaggtttcaagcacaaaactgggcggccatttgggcagacaccaaacaagctgcagtagttcttttttcccataccccagtggcgcctggaacagcagcgagacagaagtgttcactccgctggaaaggggtgctgaagccagggagccaagtggtctggctcagcaggtcccactcccacggagcccagcaaactaagattcactggcttgaaattctcgttgccagcacagcagcagtctgagattgacctgggacgctagagcttggtgaggggacgggcgtccgccattgccgaggcttgagtaggcagttttacactcacagtgtaaactaagccactgggaagttcgaactgggcagagcccactgcagctcaacaaggctgccatggccagattgccagatttcccttgtctgggcagggcatctctgaaaaagtggcagcaaccccagacagggacttatagataaaacccccatctccctgggacagagcacctggagaaaggggaggctgtgggcgcaacttcatcagatttaaacatccctgcctgacgactctgaagagagcagtggacctcccagcacaccgatcaagctctgctaagggtcagactgcctcctcaagtgggtccctgacccccgtgtatcctgacggggagacacctcctagtaggggccaaccgacacttgatacagaagagctctggctggcatctggcaggtgcccctctggaacgaagcttccagaggaaagatcaggcagcaatctttgctgttctgcagcctccgctggcgatacctaggcaaacagggtcgagagtggacctctagcaaactccagcagaccggcagcacatgggcctgtcagaaggaaaactaacaaacagaaaggaacagcacgtccactcaaagatcccaaccgaaggtcaccaagaaaggatatcagtgatagaagatcaaattaatgaaataaaatgtgaagacaagattagagaaaaaagaataaaaaggaacaaacaaaggctccaagaaatatgggactatgtgaaaagaccaaatctatgttcgattggtgtacctgaaagtgacagagagaatggaaccaacttggaaaacactctgcaggatattatccagaagaacttccccaatctagcaagacaggccaacattccaattcaggaaatacagagaccaccacaaagatactcctcaagaatgcataatcatcaagacacataatcatcagatttaccaaagattaaatgaaggaaaaaatgttaagggcagccagagagaaagatcaggttacccacaaagggaagcccatcagactaacagcagatctctcagcagaaacctacaagccagaagagagtgggggccaatattcaacctttctaaagaaaacaattttcaacccagaatttcatatccagccaaactaagcttcataagcaaaggagaaataaaatcttttacagacaagcaaatgctgagagattttgtcaccaccaggcctgccttacaagagctcttgaaggaagcactaaatatggaaaggaaaaaccggtaccagccactgcaaaagcataccaaattgtaaagaacatcgacgctatgaagaaactgcatcaactaatgggcaaaacaaccagctagcatcataatgacaggatcaaattcacacataacaatattaaccttaaatgtaaacgggctaaatgccacaattaaaagacacagactggcaaattggataaagagtcaagacctatcagtgtgctatattcaggagacccatctcacatgcaaaaaacacacatgggctcaaaataaagggatggaggatgatttatcaagcaaatggaaagcaaaaaaaaaaaaaaaaaagcaagagctaccatccttatctctgatacaaaagacttaaaaccaacaaagatcaaaagagaaaaagaagggcactacataatgataaagggatcaatacagcaagaagagctaactatcctaaatatatatgcacccaatacaggagcacccagattcataaagcaagttcttagagacctacaaagagacttagactaccacacaataacagtgggagattttaacaccccactaccaatattagacagatcaacaagacagaaaattaacaaggatattcaggacttgaactcagctcttgaccaagcggacctaataggcatctacagaactcttcaccccaaatcaacagaatatacattcttcttagcacttcatcgcacttattctaaaattgaccacataattggaagtaaaacactcctcagcaaatgcaaaagaacgcaaatcataacaaacagtctttcaaaccacagtgcaatcaaactggaactcaggattaagaaactcactccaaaccgcacaactatatggaaaccgaacaacctgctcctaaatgactactgagcaaataacgaaatgaaggcagaaataaagatgttctttgaaatcaatgagaacgaagacacaatgtaccagaatctctgggacatatttaaagcaaaaaacaaaacaaaacaaaaaaggaaaatttcaggccaatatccctgatgcacactgatactaaatcctcaaagatgttgaataggtatttctccgaagaagatacacaaatagccataagaacatgagaagatgctcaaaattatttttcattggggaaatgcaaataaaaaccaaaatgataccagtctacacccattaggatgctataataacaggtgttggtgaggatatgaagaaaatgaaacactcatacattgctggtgggaatgtaaaatggtatagctgctgtggaaaacagcttggcatttccttgaaaagtcaaacatagagttaccattacagttaccatatgaaccaacaattccactcctaattatatactcaagagaactgaaacacatgtccacacaaaaatctgtatatgagtgtttacagcaacactattcataatagccaaaaggtagaaacagatcaaatgtccaccaatgaatgaatggataaacaaaacatggcatatctataaatagaatattattcagtcatagaaagaagtagtgatatttgctacagtatgcaaggagcttggaaacatgatgctaagtgaagaagctagacgctaaaggtcacattattgtttgatttcatttatgtgatatatccagaataggcaaatccacagacatagaaagaagactagtggctgccagggcccagaggaatgtgtgaatagggagagactttttcatggatacaaggcttctcttggggtgatgataaagttctggaattaggtagtggtgacagttgcaaacattgcggatatactaaaaccattcaaatgtacattttaaaatggttaaaatagtgactttcatcttaatatttttatttttaaaaaacagaattcataactagagatatgtatttgaaagtcatcagtgtaaagataatcataaagtcataggcataggtatgactgctcaagtagatttgtagataattaagagagaaccaggaattaaaccctagagaacaaaactgtgtgtgtgcatatgtgagtgcatgtgtgtagtgaaagagaccaagcaggtacaatcaggctgtaacagattaaactgaaacaaaaacaaacagaacactataactgattattatttaagtatttgaaagaagtatttcttaatttgaaagaagtacaaagtaaaactttgaaaatcaaagaaaacttgggttctatataaatgcacctaaacctgcaatattacaaatggtacctgtcagtaacttccatgaaattgagcagcaaggtatcaaaaagagcaatcagttctttctgaagttgttgcctgacagcagtccggatatcatctgtttcttctcgtgcctgtgactctgtcagaaccaagaggtctaacagtgggtttgcactctaaaaaatgaaatttgtaaaaaatgtatttactaattgaactatatattgtttcctataaagggtttggttgctaagcaagttctagtaagagctatattacctaactagtaggtgtgggcctttactgcattagtagagatgttctaaattcaaaagatgtttaatatattctcaacaaaagaaaaacatatttatcatataaaatagaaaaaaaggacgagaaaaacaaaaccacacataatcatgccacacagaaattgccactattatatattgatatataactctcctttttgtttctgagaatataaacagaattaaaacagtacatttttcacaaacccgtatcaagtgaaaaaaatcactactgtaaccattttttcctacttcccgttattaacaatatttctgcaaaaacattagtttaatatctgattgtttttcaacaataaggatttaccacactaactcctggataatcaatgatgcataatttcactaagctgcaacacacagtgtactcaagttggattttatcttatgtatgaattctgcaataaaattactaaatcaaaatattatagtagttttaattttttgatatatattgccaaattgtccctgtaaaaaatgtaccaatacatacaattacacaggacatgaaaagacccacagcacccaagccagtgctatgtggattattactgcaataatctttgccaccttgataggctagtaaacaaatactagttctttctaaagtttttcctcttttcccaactaaaaaaaaaatagataaaggaatataagaggattatttctaataatattgacaaaagaaaacgttacattaatcagaagcattaatagatatatgggatatttattaatcatctatgatgcctcaggcactgtgctaaaaaaaaaagatagtaagatttcatttgactttttgaataaactagaagatttgcattttcattcctgttttacagatgggaacatagatttataaagaggttaaataattgtctaagtcttagacagacaagggcagagcaagaagcatcttactccaaagctagttaatattccatcctcagcacagtgtcacatcactagtgcatgtaaaaacatacaaaaagagatacaatcaaaatgtaactattgttcttataaaatccttcacctaaaagagctcaactcaaaattaactgcattctctttagggaaaagaaatgaaaatatgtaaagaaacctctaaattgcttatagtatatagagatatatacaattataaataatataactgagagcttttggaaactagtagtgacattttgctcttattttacagtattttaacatctaaatagtttttttcccaactttttcttttatcttaagcaatatatgtctttggataaattaagattgaataagacataactgcaacttttatgtttcatacatgaataaaagaatcgaaatacacatttagtaaatcataaaaataaataaattttctataatgttctgagccctaaatatccaaaagctgactcacattcacgtgccttctgactcccaaaactactgacaaaatgaacaaactgtttataccaagacgcaaactccatcttgtaaaacaattttattattaggaattattaattctgatatgctgataaaaattaagtagaagctactattaatacatgaatatactgaaacagtatgtgtatacctaaaaattaagattctcccaaagaatctcatcctattaataacttgcttccacttgaagattactgaagtttttttttctcttttcacctttgatttacatgttaacactgaaattcagtgaacctcagcaataccacttgtaaaatatagggtgaattaccatttctcaagtacaatagagtagaataagatgtctctactgatgcctacagatgtcaagtgcttaatcatatctgaagtttttgtctttagacgttaggattcaatcctaattttaaaccaactacttgggccattattttgtcactgttgacctctaaaaggcaaccatttctataatgatggctcattttgtttacacacacagttaccactcatcatatccaactttacatccatcagcaagctatgccaaaagtaactgcaagaccctcaataatgtctgagtgcacattgagcccgttacgggaaagccagccaaggaaaatatatatgctgtgtagttctgctgagcttcaccaaaagaagaaaaaaactaacagccccacatttgtgaacttccatcaaaaaaatgcattccaaaaagaaaggtattcaaattcagcacttctaggttactataaacaaaatatcatattaaaaacagattagaggtgcaataaactcctaaattgcctaagaattacaatatgtttgtaataagtgaatgtcttgataaaacacatggaaaaaaatttcacaagagaaagttcctaaatcttccctcgggaagttagctgatttttcttttcacttcctcttagcattcttctgactaatcaggcgttcatatctgcctaattttgtttttgcaaccacaacttttgtatatcttttcatgtatgtccatacattcaaagcaatttacttggaaatgttattttactgagcttcttaaatcatttctcacttattttactcacttcaaaggataaactttaaaaggtacttgattttctatttccaggttccctttatcctaaacattggtagttatataacatatattaatttatcttgtagcataatatttagggagtaaacccaactgatagtgaacacttaagttcacttttgtgcactcttaaaagtagtattatttataacacttgtggtgataatatatgagataaagtagaagctttccgaagaaaggtttaataccatacaaaaccaaataagtaaatgtaactgtaccaaaaatccttttcaaaaactgcattaaaattatagtacaatcatctagagtcttgtaggaatttaattttaatttcataactatgaataaattataaaatatacataaaccttatgacatactacaaaattaacagtacatgtatggtgttacaagtcttaacaaatataacaagactgaaatcatatctaatatcatttctgaccatagtgataaaaaactagaagtcaccaaaagaaggaattctggagtattcacatatacataaaaattaagcaacatgctcctgaacaatcagtgggtcaaagaaaaagctaaaagggaaattttaaaatatcatgagacaaacaaaaatggacaccaaaccaaccaaaacttatgggatacagcaaaagcaggtctaagaaggacatacataacaataaacatctatgtcaaaaagaaagatatcaagtaaacaacctcaaggaactagaaaaagaagcataaatgaagccaaaacttagtaaaaagaaaacaatgaagataagggcagatacaaatgaaatagaaactggaaaaacaatagaaaacagtaacagaatcaagaattgagattttgaaaagatgaacaaaattgacaaacctttagctagactaataaaaaaagaagacaaaatgagaaacgaaaagggaagacattacaacagataccacagaaacacaaggaatcgtaagagactattatgaacaatttcatgtcaacaaattggacaaccaagtggaaaaaattctagacacatagagctaccaagatggaatcatgaagaaacagaaaatctgaacagaccaataataaggagattaaatcagtaatgcaaagtctttcaccaaaaaaaagcccaagacctgattgatggcttcactgctgaattccaccaaacatttaaagaattaatactaatctctgtactcctaaaaccaaatgaagaaggaatacttccaaactcactttatgacggcagcattacactgataccaaagccagacgtgggaactacaagaaaagaaaattacaggctaatatccctgataaacacagatataaaaaatcctttaccaaatactggcaaactgaaaccaagagcacaataaaaagatcactcactataatcaagtggaattcattccagggatgcaaggatggttcaacatacacaaatgcgtaaatgtgatacaccaaattaacagaattaagaacaaaaaccacatgattataccaacagatgcagaaaaagcatttgacaaaattcaacatcctttcataataaaaactctcaataaattaagtagaaaaggaatcccaacacaataaaggccatatatgaaaaacccacagctaacatcattctcaatggtgaaaagtttaaagctttttctctaagatcaggaacaagacaaggatgtctactctcaccatgtctattcaatatggtactggaaatcctagccagagcaattagtatatagaaagaaataaaaggcatccacattagaaaaaaggcaagttaagctgtccctctatgctgatgatataatcttaaatctagaaaaacctagactccaccaaaaaactttgatcttaaaaatgaattcaataaagttgcaggatacaaaatcaacttataaaaaatcagtagcatttctatacagtaaccgcgcccccccaaaaaaaaacctcatttaaaatagctaccaaaaaaaattaagatatttaggaataaatttaatcaaaaggtgaaagatctctacactaatgtccaagttgcaggtaccagaatgaaatcacgctccaaggaaaggggaggggagggaagaggaaaatggaaggaaaaagcaaaggagaaagggaagggagaagggaagggaggaaaagaaaggacaggaaagaagaaatgaaaggagactaacaacccaattgtggcggagaaccagcaaggacatcaagatacaattcatgaaaagaccgaatatgaaaaaatctccatctaattcaaaataagttatctatttataaaaccacaaaaacctcagcacacacgcacctctacaatttgactcagcaattacaattctagaaattcagtctataaatatacttgcatatataagtaaccttgaaagtaatacatggtttccatttttgttaaatcttaactagtgataaaattaaggttttgtgtgcttcttgtaattaactacatagcttattactgagttaataaatgtttattgagagctcactatgtgcaaggcactataataaatgctgggtatgcaataatgaacaaaacagtccctaccttcaccaatctacaataaaggaaaagataattactatggtttgaacattccctccaaaattcatgttgaaatttaatccccaaagtaacagtattgagaggtggggcctttggaggtgactggatcatgaaggccctaccctcatgaatagactaatccattcatggatagtggattaatgggttatcatggaaggggaactgatggctttgtaagaagagaaaaacctgagatagcacatcagcatgctcagccccctcaccacatataccctgcatcacctcgggactcttcagagagtccccactgcaagaaggctctcaccagatatgccctcttaaacctggacttcctgcaccccataactgtaagaaataaattttgttttttataaattacccagcttctgatattatgttaaaaacaacagaaaacagcctaagacgataataaacctctaaataagttttatatacacacaaacattcatatcagttagcatttctgacaacacagtaattcatatttttacataaaattatctctaagtttcgcaaatgtgttaatatataatgaaacatatttgccttataagatccactatgtcctatatcagtttaggccctcttttctagttttgttttgtttttcttcttatttgtgtaaagctttatcttagctaagttgagtaaattcatacggtatttgcaaataaatacataaagagacagatagaccaacaacagggacctggcttcttgggttcttcacacgcttcttagaataagaaatctgaatagccaaaatttttagaatagctatttagaaaaattttagagccaggcacggtggctcacgcctgtaatcccagcactttgagaggccaaggtgggcggatcacctgaggtccggagttcaagacgagcctggccaacatggtgaaaccctgtctctactaaaaatacaaaaattagctgggcgtggtggcaggcacctgtaatcccagctactcaggaggctgaggcaggagaatcatttgaacccaggaggcagaggttgcagtgagccaagatcgcaccattgcattccagcctgggtgacagggcgagacgccgtctcaaaaaaaataaaaaaaaaaaatttagaatttttagaagagctaaaaatctgacagtagtgggggctagaagggtaaatattccagtaaccgttatttaaggcctgaacacactttatctttataactgcaccatcactataccccctcctgcctccatctggctttgttagctaactctcaacatgcctatctggacatccaccctgtcccctgccacctgaactgaaatccccacttaaaaatacagttgcagcagaaagttcacatgcagaacaggttttattaaacacaagactgtaggtcccattcactgtacagaattttaataaacacattcacaatcgtatcaggaaagccatgttgttatgagccattcattacatgaagactactttaccaagcatagacaatataaaattatccttttccataatataatgttaatgatttctacaaataagttatttcccaaacttaaaatccaaattccttaacaccacttacatgtctaagaagtaattcgagaatccagtttagaagttctagtgaagaattttttctttgttcctttattaatttatttaaaaaatgtatgatatctattagcagtttctcatcttcagtgcaagcaggaagcacctgtaaaaacctataatgaaaagacaataatcatggtttctggcgctttaaaatacacaataccactgttcatcatagatatgtggacttaacagatgtcttgtgaggatgctattttatgagacactgttttaaatgctttggaaaatgcaaagttgaaacaaactgggtatctgccttcaagaacatgagcttatagtggaaaaaacatgtggacaagtaactaaaataactagaagtgacaaatatcataagagaaaaataacaaattcagaaaaagtaccaaaaaaataccaaggggaaaaacactgactctaataaccgcccagtgaaacttgcttttcatactgggaatgtcatgtttcactgatgagaagaattagtacttcaaacctaattctgaccaactcgaaaaaataaggtaataaagtgagggggaaaaaaaggcctgcaaggacgctactagagtttgtaacaggcaaggaaaacactgaaggtagacttaggatgaaatttctttttaagttcagagcaaaaggatatgagccaattttctaagatttctttaaaaaaaaaaactggtttaagagagctaaaagattagtagacaataaaacttttatttaaaagggagaagtagtttggaaatcgttttttttaaaaagcaatcagcaagagatatgagatccaattttatctgtaatgttttattttttataaatctaaagccattgcatcaaaatgttaataagagtgacaataatacgaatcttaatactcagcatttatggagcaccaaccttgtgccagcctatgttctaacagcagggtttctgtcaaacttcataacaacattatgaagtaggcacctctatttcaaagacaagaagacccaagcaaaaatatggttaagtcgtttttccacagtcacacggctagcaagttttaaaacaggaatactaaactaagcagtccaacaccagggatatataatgctgtatttcttagtaatgtggtgtttgtctcattattatttttccttacttaaaattctcacatccccaaaatgacattcagctgagtaggatggcaagtgccggattatgaaaattgagaggtgattctaacaaccatagatctttgggagatttatgatttaacaatcacaaagattataagaagtcttctatgatatccagtgtaacattaaaatatcacctctgtaaccccattttataaccaccctcatatcccctaaatctaagtgtactatcctcttttcaattcctcttgaagacacaagacactctttcctaactcagggcctatccctttgcctggcatttaaaaaaaaaattaatttgtataatatttgttgaatatggcattttagtctagaggagaaataatatattctgcaagtggttgtgagtcaactgaccatccatttacggattcaaagtatcaaatttctgtcacataacatgcaccaaactatattccatttatttgttttatttttaactgacaaataataattgtatgtatctttaggatacaatgtggtgttctgacacatgtatacattgtggaatgatccaatcaggctaattaacataccaatcacctcaaatacttatttctctgtggtgagaacatttaacatctattcttttagctattttgaaacatatattattattaactatagtcactatgctgtaagagatcaccagaactcattcctcttgtctaactggaattttgtaacctctcagcaacgtctcccttttccctacccatatccacctgccacttgcctctggtaacaattctactctacttctttgaattcgacttttttagattccatatataagacagatcatgtggtatttgtttctctgtgtgcctggtatcttttcggcttccaatcccatagacttttaacatccttctacctgttatgccttggcttaagcttcattctctgaaccactttctctctactgaagagggatagggtgctcctctaatgcagtttcctaatagtctgcttggaagcatttctacttttgattatacttttagctgtcttaattccaagttccatgagagcaggaccctatcagttttgcccactgctatatttcctacaagagtgacacctagtaggtgatcaataaatgtttgttgaatgatggaaaagcagtaggaaaagaaaggcagtagcccctttcttcctattcaccccatgccacagcaccacacccatataaggtatcatgtccagatctcagggagagtcctaagaaacacaatacccttgtaaaatagcatgaacaaatgagaagtctggacactgtggcttttaaagtctatctaaaaaaaaaaacaaatcatttaaagcagggtggggggaatagagaagaaattatagttatgtttaaatgaagagctgtcacatgtgaagacattatttattctgtgagtttaaaggacagaataacaggtagaaatgatcaggtacagtctaaaagaacaaaaaacttacgaataatcacagcgcaaaaacagaatgaatatccttcaaaggaggtgttcacgctgaggctgcatggccaactgtatactatgacttatgcgatatgtgagggatataaaaaggaatgtaataaacccaaggcacatgagaaaacaaatatttaaacaactgtagaagtaatgcaggaaagccacatgacaatcagggtaactagaattccacatacatcacagagtaagaagaccctggagctcaaggaagagtagatattcacaaggcagccaaggagttaactatgtaaaagcaaggatgtataaaacagaagtgtatgccctaaaatatcaagcagtttcataaaaccccaatatttgcacttcatagaaacacagcatatgttagagagagaggaggaaactgtagctgaaaaggtaagcaagagctagatcaaaaagaactttctacagcatgctaaggggttggaattctattaatatctagcacaccatggaagagaacccacaggtgacatgtatttcagaaggatcattcaggaagcaacataaatgagtggcataaggttaaaagcagaaaaaccaattcgctagtcagtctacagtctggtgaaaaatggagaaaaacagtagcaataggacttccagtaggaaaggagtagagaggcattaaacatgcaaactcaacagaaactagttgaaagaagactctagatacctctgacaacttgtaatcctactaaaccatgactatcatctgttttcttaaaataagtttccaaaatgatattagattataattgtatgcttgtgtgttagcatacacatataaaaacatacacataaattaatgttgggctgttaaaataatcatcttggaaagttatgtttagaagccacagtaccgtaagtaaaaagattttagaaaccatgttttttgtcaaactgaaatatacttttgttaatagtgataaatagtcatggtttagggtggtgttcatttcggtatacatgtaaaaatcatttttacccttctctggatagttgagtttgctaatatcattttttagtaaaaaattaaatataacttcaaaatataataagacttccttacatctgctgtttaaatgacctgagaggacaatttcaaaatatctgagcaaagccagaattattctaacatacacactcactcctaaaaggacctcttttgcggaacattcatttggatatatcatatatttgaaaaattagcctcaaagtatatttactgacatggaaaatgtgtaaaaaataacattatttttaaaatacaataaaaaaccattcacacaggtatgaacatgcttctctatattttgttttgtctagaatgatataatttgaaatagctgtattttaaaaatattaaactaagcttataaaaatgttctcaatatctcaatactttatacagccatgatttatgggaatcttctatctccaagcaccctttaagctgttggttcatcttagataatcagtcaaaaagataatgttcctttctatcattaaactgaatgaaagcaaaactaaagtttcccaaagcctcattagtacatacattgctggaagtaaagtttttaaaaagttttcatgaaaaaaggtggattctgtgatatatatttttgatacattccttagtgaaacataatacagcagaaatacatgaatatttataaattaggcagtagtgtctgtgttgccatgatcaaacacaggcctaaaaaccaaatacaagatgaatattatatatgcatgtgtgtatatattaaacatatacacagtctatactctccacttacactagtcctgaggaaactaaccataaaaaatgtgatgctcacatacagttactgctattgggcaatttgaaatactctaaaggcttccactgacccacagtttgagagtctttcctgtaatgtggtattgcatactatttctatggttttaattcacaagagaaagaaaacttagtgcaatgaattcaatcagcttttatgttaaaatttcttttgacaaatagggacatattacatttatttaaagtgaaggatttatgcattcttcaactggcgagactgtttaaatgcgggagtgtgctgataaatatgtaactgagagtgctgacttattgtgtttgtcaatttccatggtgtaaatatactactgtagacaatgtggagctaccatgtaacatgaagttgtgaagagatgcacagtggtactccattgtagttatttccataaaatacatacccctgtagtgcatatgtatgcataacctcaagaacaaagataacagtaaaatgttgccacataattagaaagtgatgtttgcatattcattaccttttgtcttcatataatttatttaattgtaagtttatataattaagaatggctgtgtttaacaatcaccttacaaaaatcctgaaaattcaaccatcagctctctcacaaggctgcattagtgggcaccagcacaccactggaaagcctaatcagataaactaatttttaaagctaaactaataaaggaattcatattttggaaactcatttaacctagcagcttaaaaactgcacattttatgttaaataataaagttatacattttatactaaagtcacatgaagaataaaatgaaaacctgcttgcagtggttgcttatcagtcttgttgcaaatgcaaccatctgctacaagttaagcatgttaaattgacaagctagagccttctcaattaactgctataaaggaccgccacatggcaatcaacttcatgaaattgagagtaaaaagaaaaatgatataatttacttaagaacaaaacaaaagcaaaacaaaacagcctgtggcaggtgtatcacagctattaatcaattcactgatgtctcaactcatttataacatggatagaaataaacattcaatttgtttcatccatgtcttatcctaattatttgcttttgtgaggtaaaattttctaagaataaattgttacaagtttattaataatcccttcaacaatgcaataactaaattaaaaatttctctttggctattattacagatgataaaaatcctggagtttttctttctatgatagcagcagtaagggcatagactcttatcttcaaaggttaggagatgaacacaatacaatgcaatccaggtctttgaaactggcagccttgaccttacactgacctgtttagtgcggtgtgccaagccaaggacttcaaggtaaccccacatggaccagggcaaccctttaaagacaatctgtcattcagaagataaaaactcatcctggtgacagcagccctaacttccctgtgggttgcagcctgaacaatggaatggaggcagtcctgcagcccactagccatgtgtgttatcttcagagtgaggatgtcctctgtagataacttcaatgcatctaaaattctagacaaaaagaaaaaaaatgaaggaggaacataaagctatttaaataaaagctcacacttatttctattataaactctcccaaaagctgttttatcttcattttcttttaacaaaaggttgacttacagccagaagaaaaactgatacatatctgtcaatattaggattttacattggcatcccaaatgtttatattgacttttcctccttataaaaatttttattcacttaagacagacagattagaatattaagatattcaaaagtaatcaccatcacactaatgataacactcatgcatatacttactgagattttgttctaatccaggacccttttcctagtgattcatatctacgaacaaatcagactttaacctctaaaacagtacagagtaaaatgctttttcatttaaagttttcccatatgatagattgttaaaagtaataaacacatgtaatatttaaaagaaagtaaaaattataactgttaaaaagcagaatcagatgataccaagggaaaaagctactggacctaaggaaaaagtaaaacttaactaattaattacaattaattaattgcaaatgctttttaaactaatataagagcttactcttgcgttttagtttcagagttcatttgcttcaacagattatcactcccatgataccatgacaggttccaagctattctcagcatatctgacaccggcttcaaggccaaacaatcagcagataagggcaaaactatggagtaaggactcacagcatggtgtccaattacatgaacaggtagatggtacctaaagaaaatgtgtacaaataattacaaactttcaaattcttaaatgctactcaaaaagatgagccacaaatgagggctagttcaatgcctcccaacccacaataatgcaaaggtttctcttagtccctattttaaacaattatcataatttatacagtatttcaattattcttttcatctcctctaaactccccagaacacttaaatcctttcttgaggacttaccacattctatgctatattagagttgttgtggagataactaatgctccttgaagtcagggaccatgaatacagtgaaccaaacataaaaggtgttcagctaaaacactgatatttactttatgccaaacactgcttattttgtatcattcattcacagttacatggtatggcactatgatacctattttacaaatgatcaaaaatgaggcttaaagctgataaatgaattgcctatgatcatagaggtcactaaatgactgaattccagcttattgttttcacttgagaacatggtttcatcatcaataaattcaacaagaaccaagaaatatgtttagaaataaaaacagattcaatagcagtatcttttaaaccaaagttaattttgttctaccgtaaagacacatgcatgtgtattttgtctcaagtttttcctttaacatggtgaaataatctaacatgcatgtaaatttgcatcctaaaaggaacaaaaagaaattttaaaactcctaaaatgtatatggaacaaaacatggtcctaaatagccaaaacaatcccgagcaaaaagaacaaagagggaggtatcacactgcctaactctgaattatgctacaaagctatagtaaccaaaacagcatgatactagcataaaaacagacacacagaccaataaaacagaataaagaatgcacaaataaatacacacatttggtcaattttcaacaaaagcaccgagaacataatttggggaaagaacagtctcttcaatgaatggtactcagaaaactggatatccatatgcagaaaaatgaaactagatctctatctctcgccacatatgaaaatcaaatcaaaatgaattaaagacttaatgtaagacctgcaactatgaaactactagaagaaaacattagagaaatgcttcaggacattagcctgggcaaagatttattaagtaagacctcaaaaacacaggcaagcaaagcaaaaataagtaaatgggatcatatcaagctaaaaagcttctgcatagcaaaggaaacagtcaacaaagtgaagagaccacctatggaatgagagaaaacacttgcaaactattcaactggcaagagattaaccatcaaaatatataaggaactcaaacaacttaacagcaaaataataataataataatccaattaaaagctgggcaaaagatctgaatagaaacttcttaaaagacatacaaatgaccaacaggtatatgaaaaaattctcaacattaccaatcatcagagaaatgcaaatcaaaaccacaatgagatatctcaccccagttaaaaaggcttttatcaacaagacaaaaaaaaataacagatgctggcaaagatgtggaggaaggagaatgctcacacactgttagtgggaatgtaaattagtagagtcattattggaaacagtatggagttcctcaaaaaactaaaaacagaacctacatatgatccaacaatcccactgctgggtatatatccaaaagaaaggaaattggtatgtcaaagagatatatgcactcccatgtttattgtagcactattcacaataaccaagatatggaatctacctaagtgtccatcaatagatgaatggattttttaaaatgtggtataaatacacaatggagtatcattcagatgtaaaaaagaatgaaatcctgtcacttgaaacaacatggatggaactggaagtcattacgttaactgaaataatccaggcacagaaaaacaaacatcacatgttctcctttatatgtgggagctaaaaaaaaaaaaaaatgatctcatggagataaagagtagaatgatgattaccacaggctgtaaaggatggtggggaaggggggaattaagaagggatggctaatgggtacataaaaatttagatagaaggaataagatctagtgttcagtagcacaatagggtaaaaatagttaacagtaatttgttgtatatttcaaaataactagaagagcagatctgaaatgttcctaacacagagaatcaataaatgttagaggtaatggacatcctaattactctgatttgatcattatacattgtatgcttatatcaaaatatcacatgtactccataaatatgtactattatatacccataaaaataaaataaactcccccaaataaataagcaagcaagcaaagtgctgtgggatatagctgaaggaactcctaagagaatggggaacacagttccttcaaagaagcaacaataaaactgacagccaatgttcctacaaaaaaatggactccaactgccaacctagaattctatacctagtgataacattttttaaaacagaaagaatttttagattaaaaaaaaaaaaaacctgacagaaatcattgctaatataagtgcactacattaaataataaaaaactcttaaaaaaacaaattctcagatggaggcagaaaaaccaaaaaagcaataaaaagtaacagaaacgaccacggtatacaaatctaaatgactatttactgcataaaataattataataacatcttatagaatttaaaatatgtatagaatttaaatacctgacaataaaagaaaaaaaaaagaagagcaaataaatggaattaatgtgttctaaggtccttgcattgtctgggatgtggtaaaaatactagttcacagtcaaggaagtaaattataatctctatattataaaagaataatcatctgtataaaatatatagaaataatgtatatagaagaatacttagctgggcacagtgactcatgcctgtaatcccaacacttttgggaggctgaggtgggagaattgcttgaagccaggagttcaagactagcctgggcaacaaagcaagatcccaatcgctacaaataaataaataaataaaatacttaatgtatatgtaactacaagttaacagctggaaaacatggactaattttaaaaattaatcaagaaaagccagagaggaaaaagaaagaaaaaaaccacattggacaaatagaaaatagcaagctaataatctgtatccaaaaatattagtaattatagtaaatgtaaaatgcattaaaatattccattaaaactgtaaataatgtcagattggacaaaaaaactcaactatatacttcttaaaaaaaaaaagtacatttaaggacacagaacagctaaaactacaaggatggaaaaatacatatcatgctaaccactaaccaaataaaagctggggaagctacagtcataagagatcgagtgaattctatatgatgaagcactgctagagataaagaaataatttcataatgatagagacaacccaccagcatgtttacaaactaaattacatggcctcaaaatacattgtcagccagaatgacaatgtcatagtggagattttaacatgcctctctgctacctgaaagaacttcacacacatataataaagtagacacagggaagatctgaacactatcaataaacctgatatattttgagacttatagaacagtatatccaacaactactacatatacattattattttcaagtacacatggaacattttaaaaagctgaccatatgctgggccataaagtaaaattcaacaaactctaaagaattaaaatcatagaaaatattttctaatgtcaatatttagctaaatattaataataaaataactagaaaacctaataaactaaatcttcactagttacccccaataactctaaacaacccttgcatcaataaaaaaaaatcacaaaacacttagaaaatattttgaactaaataataaaatatggcatatcaaattcgtggaatataccaaaagccatacttagaaacattgatagctttaaatgaaagggcggctaataatcaatggccaatcctccagtaagttagaaaatgaacagaaaattaagtttgaaaaacacagaaggaagaaaataataaaaagcaaagagtaatacatcaggaccactttgagatacactatacatccatcagatgggcaacaattttttaaatgccaacattactgtgagtaaaagagtaataaaaccctttctcctctttacggacaaacatgatattgaggtaactctctgtccctttacccagtaaaatcagatagatatggaatgtcaagaatttactaagctgctttgcttatgatgaaaatgactccccacatctggactgagacatctaggaataaactataaatgcatgatgggatgtcacagctctgagcaatcttgagtgctgtggctcttataagcaacctggaaactatgcctacagcacacttactagagaacatattttctatttgggacatgaggcttccaagccaagacagctcccagcacccacaaatgtgatctcattctaagcatgactactgcagtcgtgtgagtttcattatttagccaaactaaacaccattaagactggtaatgcaaataccaaaggctagtgaggatgtggggcagctagtacttttccactgatggtaggaatgtaaatcagcacaacaacttcgtaatactgtctggtaacatctactaaagctaaacataaatatcctatattccaacaatgacacgtgttcaagaatgttcttagcagtcatttcttcataatagcccaaaacagaaaacaaattaaacatccacaaatagaatggtaaataaaagtgttgtatattcttagacagaatactacatagaataaaaatgaaccaactattgattgcttcatgcagcaacatggacaaatctctccaagttgagcaaaaagcaatataataatgcactctatttataaagttcaaaaactagcaaaaataatgtacagcaatagaaattaaaataggattacattttggggtggtagaaggtaatgagaaagcacaaaaagggtttccggtctgtcagtaatattctatgtcaatctgtgtgagataaataagtacgtttactcagaaaaattcaagggctgtacccttatgacttgtatgctttatgtacgatatatgtcaataaaaacaatttactttttacaaaagtctaaagagacatgaaaaccaaatacaatgcagaaccttaactggttattgcattctgaaaaaatatacacaaaagatacttggagataactggagaaaccacaccatgttatagaattatttttaatcttgttagatgggatcatattgtagcagttatgtagaataatgtccttaacttaaggatgtgcatgctggaatatataggaaaggagtgaatttatgtctgaaacttatttccaattggtgggtgagggagaattaaatataaataaaaatatatattaggagagagaaagcaaagagactcatatgtaaataattgatgactctaggctgaacgacatacaagtatgcaccgtatagctttcaactttcctgtaaatttgaacggtatcaaaataaaaaattggtggtggggagatatacttactgaaatcttcaaagcaccattgtgaaggaaccatgaaagcccaagttatgggatttaaatgctaaatgaaaattgtgacaaattatagattttgatttccctttctgtaacaacatttcgtccttcaagaaaatcagagaaataaatcctttaccttctaaaaacggaaacaggcaaactgaagaccgatggcaaagaaggtttattggaaggattaacagacctatttcataaaagaaaaacaaaaacaaagaaacaactgagtagaccaagttttgtctaacaaatacaacttacctcacttcgttgactgcaaatgaaatcaagcagtgcaactgagtctatcatttagtatagaaacaacatgtttgctacttcctagatttgcttatgaagagtaaattatgttttaaaaaaaaattccacataacaaatgattcatacaatgcagtggtgggactagcaggtggactttgtgcgtctcctcccacggatcctgctcaagatcagcgctaatcatatactatcgtcctaaatatcttccgaggttttttaaaaatcatgaaatattaagaaaaaaacacatagttgaaggtatgtactaaaaatgtattaaagacaaaaattactgcagtaattttaaagtttatatttagtaatgtttaaaaataaaatttgagatagactttctgagctaataggcttttgaatactgtttattcaaatcaaaattcataccacatatgtgtagcatggacagcataagcttcgtaaatcagaaatttccatgccttgctataagattacatcagatacctgagataaatagttaagagtaaaaaacttataaattcttatatctcaccacatatccattctcgatacttcatcaaataatagaagacaaaatagtgctccaacttcagtcacgacactacaatcttcatgaaatattaaggaaactgaataaaaagaagcacaactttatgaaatatttgtacgtctagaaagaatgaacttcaaatttaaaatatcttgatttgaagagaaaagaaatgcaacataaacccagataaggtgacactaaaacacaggctttcatctcaaacttgtggatgtacaagaatcacctggaaggctggttaaaacagtttctgattggataggtttagggtggagcctgtgaatgtgaatttctaataagttctcagaggatgcagatgctgccagtccaggagccacacttgtagatacactcactagacactgtctagtcttaggtaattagagaaacaaactgatacagcctctaagaaggttatgccgagtcagataattctagctaaagtttcctcaccaagagatcttattttataacttttgccctttactacaaacatgtgatcacagaacttggatttgactttaaaatgttatccttgggctgtgtcattgttttggttccttttaattatgacaagatgatggaaaagggaagtgctctgaatggacagacttaacactagctctaccacttactacttagctaaatgccctggtgagattctttaacattaagtctcagttcccacttctgtaatgatcccaatgctacaatctccttgaaacctatgaaattctaaacaaagaagtacgatgttatctcacaggaataacaacataatacacagttagcaaattcagggaagcagcaataagaagttttgagagaagagatttttcctaactgcaggaaaagaaaatcatccttatgtaattggcatgattaaaaatagccataaaccaaaaagtaaagaaacagagaacatgtaaaaattaacttataataaaagacatttcacatcagtgatgaatagaatgaaccataatatttccaaataaataagaattacagcaatgcctttgcctgatttcaaatttaatttttttaaacaacacttgaaacacaggaaaagtgttttcaatctggaactagagaaagtcctacttgaagagcatgataaaaaattgcccaactgccataacagaaaagttctatatgtttccataaaatatttaagtttaaggttaaaaatataataataaataaatttaaaggatagaaaagttgagagaaaatattaatcacataaaatcaagcataaggattgtgcctatcttataataaaaaaccctacaagtcactaaaaagaaagtaaatacaacaggaaaataagtaatccatagatgaagaaatttgaatatatatgaaaagataacttcactaaaactaaaataagaaaataaaacaattatatatttttacctataagattaaaaaaaattaatgagacatattcagtgttggcaaagttgtaatgaaaataagcatttttaaacacctttggtgagagtgatttggaaaggaacttaaccattatcttataaaatctctttgacctaggaattccaacactgaatgcacaaagatgatcacacaacatgattactgtcatggtgaaaaatctaaaacaaatacccagtaacatagcaaactgaaattctgcaacaccagtgcagtagtttttagggttttttaaagaatgtatactcacatgaaataatatagaaagatattcaagttacatttccagttgaaaaaaggaagcaacacaatactgtaatatacagaatgaaaactacatgtgtatgtagaaaaaatcattcggaaaaatatattcctaatgataaccagaacagtcttctttggggaaattgagaacgagaagaaaatgaaaacttttagaatttgtatagttctatattgcctgaatttttacaatggggatgtataggtctgtgattatttaaaacagaaacaaacaaaggtaaggaagtttcgattctctctcagtagcaaagtaaataacccaataaccattttttggttatagccttggccaagttgctaaatctctctagacctcacacagatggtatagtaaatgatttctaagttaatttctaaccctgaaatacactatagaattctgtcataacataaagtttataattcaaagcagtgttatctgagaagttatttattgtactcatttgatccactatccatgctacagaaataatcttcctaaaacacatactcccctgtttaacaaccttaaacagctcttcactgctgtttaataaaatctcccaggccctgcacgaactgccctccctgcctcatcccatcatttccccttcactccacactccccaaatccagccagctccatctcaaacacatcaatttctcatacacacaaccacggctccatctagaagtcaatcttgcctatttgaactcctactcatttctgaaattccatcttagatgccacattccctagaaacaatctctgatacttttcaccaaccaatctgaccagcatgtcctctggcaccaggaatccccaattacaagtattactgtggtgtactgtatatttacttgtcaatgtctccaactctactgtaagctccatgagggtcatttaccatgctcaccaatataacccaagggcctagcattgcacctagcacaaagcatgtgcttaataaacgtttgctgagaaatgggttttcttggttaagcagctggttaaaaattaatttttcggccaggcacagtggctcacgactgtaatcccagcactttgggaggccaaggcaggtggatcacatgaggtcaggagttcgagaccagcctggccaacatggagaaacctagcctctactaaaaatacaaaaattacccaggcatggtggcaggcacctgtaatcccagctactcaggaggctgaggcaggagaaatgcttgaacccaggaggcagaggttgcactgagccgagattgtgccactgcactccagcctgggtgataagagtgaaattctttctcaataaataaataagtaagtaagtaaaatttttcctgaaactaaatccattaatggaggatactatattcattctcaaactcattgaaagtaatttccacaaacagcaatgaaatagaaaaactgaaatactgaaaagggtatagattatattgccttgaaatgtgcttttgaatccagtaggtgttcataataagttccatgcttgaataatttaaatgaaaattataaatgaaaaggtaaaccaggaactaaattcaagtgaatgaggttaataagaagacaattattaacaggattaaagaaaactaaaaatccgtaactgctgctctttcagatgatcagtctatacaatcttataaaaacgttatagtccactcaaaatgttatgagcctaaacacactgaatctgtttagagctttacctggttttagggctgctacttaaataaactgcatcttactcacttggcaagcagaagccaacaggaggaaaagatgctaaaataaaatgactacattataataacatattttgaacataaatctcacttatctcctatatgcctgataatagacaagatgaagcacattcagatgcttgtacgtgactcttcagcacattcagatgattctacatgactcttgcaaaatatcaaaaagcagtggcctaagtctctaagaaaaaaaatagtacaaaatgttaccaagctctccattgagaaaaaaaaaaaaacagagaagacaggaaggacaaaactacatgaaacgtgttcatctaacaccttactaaattagaatcaaattaaaatgggtttttaaaaaccacattttatagaatgtaataaatttaggctcagagtcatttaggatggtctagtttctactcacacaggttgagcctatactcttaacacctgtcaaatgaaataatcagacaaaatgtaccaagatccaaaggtataagcaaaacaagaaagacgaaagagatattggaaagaagatagtaataacagcagctgcaactttctctctttatagataatagtttactgtctgagcaccagatgacatctacatcaaggcacaaagaacaatcagaggtttcagcttttctcagctctagcctccactcagcaacaggattagaaagcaatttccacaaaaatattaaacattttccatttacattagtagtgtattcactaataaatgctgttgttctaatagtaaaataaaaagtaaatgtgacttacaattaaagaagaaacacttaaaatttaagaacaatctaattattagcagattttcttttatttacctctgaataacacggtcaaaagagaagactgttgcgagagcgaaacacgcatgactggatcaccacataaaaccttcctcaagagtgtgaggcatggttgtaccaaacattctacaacctgggccaggaggaaaaacacagcttttcattttcaccaattatcaggtgagatcaaacagaccataatattatcttactctaaattttatgcgttttcatcaaaattatctgaaactaaaatgtaaataaatactaggaattactttccactgaaagtaagtttcgtatatacttctatcacctatcttatggaaattttaggattagttttcctttatagagactccacttttcgaatttaaaaaaaaaaaatgaatgagataggaggtgttacttagaatttaaaatccaagtactcatccaaattctgctcagttcaatttcagatctgattaatcaaaacagcctgtaaaacaatgtctagatgcacattagccttaccttgccatcttgactcacacattcatttaaatactcaattattttgtcaattaagcataactttttcaccacagcatgcattttaatatctgtagataaaaaaagttactaaaagttaaagcacattttttgtagtttaaaacacgtattttgaaatactcagaactgatatccacacaaccttcaaactattaaaaatacttagacctggggttgacataagagtatgaaacttttaactttttactttacgtacacctgtccaatttgaaaatgtttaagtaaaaagcatatcttacttctgtcacataaaatacaaaactataaaaaaagaattatggaactagttcagactctgaaaactacgagaatttaagtgtacaaatgaatgcttatatttatacatgcaaattatcttctttatattatttcattgactcttccaaatttatcaccttcaaatgtttataattctccacaagctcatgtgtaaaatatgacttacaacatgaacatttttctatctataaaaaaatctctaacctcaaactattaatagcaaatataaaaggaacaagattataatacactatatatttctggagaacttgagcttctttttaataagcatatattcacatattatgtttgtaataaagaagtttttgtatatacataaaaaaatcttatatgtatagacatgtgcacacgcacacacaaatgttaccggaacccaaaactgtaattgattatatattcgttacaagtatttaacaacttgcagacaaattttctcctatattctcattaggaaaaacacatacactcacatactgatattgaagtggaagctatcattgtaacaatctttagctgctacttaaaaaaaaaaatttccattgccccccaatatagtgcataccaaaattataaggcatacttttgaaatgttaacaatattgaaggaatactctttaacgagtttttcttgatcttttttttaaccagggctttccacattttctagtcttcttttctgtagtctgtgtgattgttgttaaaactaaaaatatgtggaatatgttttttcaaataactctctcattccagtttccactaatgtcaagacaagaagtgctaaccataaaaatctttttacataaactcaaagttatcatttctcataaatattaaagtacatacatcacgtatggggaaaaattcaaaactaacccaaagaacaaaagcctatggaataacaacactacaaacaaagctaacagtgtattacactagttgtttttaaaaataaacatttatacaccatggaatactatgcagccataaaaaaggatgagttcacatcctttgcagggacatggatgaagctggaaaccatcattctcagcaaactatcacaaagacagaaaaccaaacaccgcatgttctcactcacaggtgggaactgaacaatgagatcacttggacacagggcggggaacatcacactcccgggcctgtcacagagttgggggttgggggagggatagcattaggagaaatacctaatataaatgagttgatgggtgcagcaaaccaacatggcacatgtatacctatgtatcaaacctgcacattgtgcacatgtaccctagaacttaaagtataatttaaaaaaataaaaataaacgtttaaagaaaaggcatagctacagtgtactatttttcttttacctaccacaaaagtattatttgattaatttccctaagcaagatggtacagattgaaaatatgatgcatgcactcagtaaacagaggaaggaacatgcacttcactattggaagtacactaatattttagaaagaagataattctatcaaatggcattttacaggtcaaataataataaggcattagcaaacttcttctgtaaagaaccaggttagtaagcatgttgttaggctttgctagacacacacatatggtctctcgcatattctttggttttggttggattttgttaacaactctaaagatgcaaaaaccattcttgagggctgtcaaaaaaaaggccacaggctggatctggcgcataaaccatagttgccaactcctgccagtaccatatggcaatctaaaattctattatcagcagtacagcaatcatttcccttaaaagacattaccttgcataatcacagctaactgttcagcagctgactttctcaaaacgagatcaacatcatctgaggtgaagatttcatataccttttcaacagtctccaactacaaaccaaaaaaaaaaaaaaaccaaaattacatttatctgcttccaattctccaataagattttatagtttgtgccctatgaacaaaagctcaaaaagtcaacttatttaaataaccaacataattacaggtaaattcacacaatgctgggttaagtagcagttctgtatttaggtcttcaaggaattgccacactgcttttcacaatggttgaactaatttacacagtcatcaacagtgtgtaagtattcccttttctccacaacctcaccagtatctgctattttttgacttttaataatagccattctggccgggtgcgatggctcacgcctataatcccagcactctgggaagctgaggtgggcagatcatctgaggtcaggagttcaagacaagcctggccaacatggtgaaaccccatctctactagaaacacaaaaggccaacattgtgaaactccatctctactaaaaatacaaaaattagctgggtgtggtagtacacacctgtaatcccagctactcgggaggctgagacaggagaatcgcttgaacccaggaggcggaggcggcagtgatccaagatcgcaccactgcactccaacctgggcaacaagagtgaaactctgtctcacaaaaaaaataaataaatagccattctgactggtgtgagatggtccctcgtagcagttttgatttgcatttctccaatgatcagtgatattgagctcttttccatatgccttttggccacatgtatgtcttcttttgaaaaatgtctgttctgtcctttgtccactttttaatggagctgtttggtttttttttgtaaatctgtttaagttccttatagatgttggatactcaaatacaaatcattctaccataaagacacatgcatgtgtatgttcactgcagcactattcacaacagcaaacacatggaatcaacctacatgcctatcaatggcagattggataaagaaaatgtggtacatatacaccatagagtaccatgcagccctaaaaaaggacgagatcatgtcttttgagggaacatggatgaagccggaggccattatccttagcaaaataacacaggaacagaaaaccaaatactgcatgttctcacttataagcaggagctaaatgatgaaaacacaaggacacaaagaggggaacaacggacactggggcctgcctgagggtggggggtaggaggcgggagaggatctgaaaaataactatcgggtactaggcttagtaccagggtgacgaaataatctgtacaacaaacccccatgacacgagtttacctatataacaaacccgcacaggtacccctgaaactgaaataaaagtttaaaataaatacataaataaataaaatttgcaacaatgatgcagtaggtcaggaaggaacttaagatctaaaataaagagtcatcatgtcaaataagttttccttttttttttttgttttttgagacagggtctcactctggtcacccaggctggagtaaagtggtgcaatctcagctcactgcagactcgacttcctgggctcaggtgattctcctacctcagcctcccaagttgctgggactacaggcatgcaccaccaaccccagctaattttttgtatttttagtagagacagggtttcaccatattgcctaggctgggctcaagtggtccacccatctcagcctcccatagtgctgggattacaggcaagagccactgtgcccggcccctctcttcttaatatacatttttgctaggaagttattcataacccattaatccattagcaaccttacaaaggtaacagaaaacaaccatgttccctaacatctttacaggtagtaccaggctaacctgagaaaagcgacccagacctatgactcaagatttccctgttgctcccagaagccaccagctggtattcccgtgggcctctccattctttcttttagaagaccccagagcaaacagcactctgggacttgctgtccagcaccccttcaaagctaccccccagacaagtcccttactgtcacttcatgctagaacagaatctgaggtggcaaaaccagcatcaggaaaaagggacaagaaaataacaaagatgaagctcctttctcccactcactgctatcttccagtcctaacatggactcacagaagacgtattagaatgccctctccccgccttcctccatacatcagggcacaggagtgactaccaatggcttagtactcagggaagtcccaaccagacctggtatgtggccagtgaagactctccaatccccctgccagcactgtcataaagccctgaacattcagtttagaagaacataatgtgtttccccattaaaaagcaaacaaacaaacaaaaaaaccgactgtattacatgtggctctaccatactactacaggccttggcaagttagtctaaaataaaacagacagattgcaaacttgagtgaaatgagaaagtacaaaacacaggaatgaatccatgaaaacagtggactagtggacagctttctttatagaattctccatcagtccagtatgctataggtacagtcctagctaaagacaggaaaatgtatttacagccgctgcccattgctgccattaccatctgagctccacctcctgtcagatcagtggcggcattcagttctcataggagtgcaaaccgtattgtgagctaggtgtgtgagggatcttggctggctgctccttaagagaatttaactaatgtctgatgatctgtcactgtctcccattacccccacatgggactgtctagttgcagaaaaacaagttcagagctcccactgattctacattatggtgagttgtacaattatttcattatatattacaatgtaataacaatagaaataaagtatacaataaatataatgcacttgaatcatcccaaaacaatactcctgccctgatccatggaaaaattgtcctgtgaaactggtccctagtgccaaaaaggttgggaccactgcaataaatcaacgtatctagaagccagataaagccagaacacaatttcaaaccagccctgaatccccatacttctctccctccccaggacatacacaaactgaagaatgtcacataaaatacatgatataaaaatgtatcaaattaccacacagtaataaactcaaaatttatagtcaccttaataaccagctctcttctgtcatccagtctgagttcaataggtttcttcccaatgaataaatcagtaactctggagagaactctggcgtctattagaggacgctttgtatcagccccttcttcactggtaagatggaatgctaaaagctttaatgctagcgaacggaccctgagaacacaaagtacttaagtcgaactttcgtgatatgcaaatgtctattttaaaagggcttgtaattacaagtaattatatatcaacaaagtacaataagtagtcacaattatactgccattactagtaataatttactttttctactaaaaattcttcgatatataattataatgatttattcaatgtaatagttataaaataaacatcagaaacaaaaaataataactacaaatgagacagactcactgagattaaatatcagtaaacttcaataagtacatctgcgaattaaatcaataactcctgtcttcaaatctagtgaactattctccaccataaaaagtatcacagaccgctgaccacagtccaaatgttaagttgaacccacaggagagtaatgacgctcataatggaagtgtgataacactacaatgtatcaaaatcttctcatattaggggccaaacagattcctgtcaaatatgaaaatacaaatactttttccttatctggaagggattaggaataaggtcagctgagtggggaggtgggagacctttcaagaaaagagtaaatactgtatgccactaaacaatgaaatagagaaacagaaaaaccactgagtggacaaaggtcactgaggcggcagatattgagacaaccatgtatctgtcactcctctgataggttcttgaactacctggaaactggacaaattttaagcaataatacaagttgccaggttttaagaactacctataagacaacaattaaaacatgcatcattagggtggccctcctactacagactagagcaggttgccttctgtatgcaggcctgccaccttgagcccctgtatcataacttttatctcactttatgacaattaataataaagaataattgataataagagctatattcccggttacacactaaatgctgaaagggcagggcccatgtctgtgttgtgtgctgctacgttcccacagctcatagatacatagtaagacacccaataaatacttcctgaatcaaacacaaagtagatatttactgcaatattgttaactgatatcatctccagaggactaataagtcaggcaaactttctccctctccatttcctgagttacctcaagagagcttagaaaggctaaacacctacctaatagttttcctttgttccttacattctaagccaatgatatctgtattcacatctggggttgtcagttgagagacaggtataacccctagcaaaggtggctagagatgagatatgtaaagcatgtatttatgcatcttgttctctggtatatacatttagcatctttttaggtttagcataggatgccagaatccagttattcctatacatgtatgtcattctttaaaacttttgagtacagtcatgtactgcataacaatgttacagtcaacagtagatcacatatgcaacagtggtgtcataggattatattactatatttttctaaaccttttctatgtttagatacacaaatgccactgtgttacaactgcatatggtattcagtacagtaacatgctgtacaggtttgtagcctagaagcaataggctataggatatagcctaggttatgtatgtagttaagttattattgcttaggtttgtgtaaggtacattctatgatgttcacacaaggacaaaatcacctaacaaagcatttctcaggatgcatccatgtcattaagcaacgcatgactgtgtatttatgtataaggtacgctatgaagttctgagaatataaagattagccaacggacagggttcctgtctacatggagtttatggatgggttgatgggatggggtagaattaatacaataaggaaaacaaatatgtcatttgaattgtttcaaattctatataatagagacttatcttacccaaagaaagatctggcctttccttgcactatgctcctgggggtgtcctgccttagaatgtctttattaaactgaggaccttgggcccgaaaaacaaacaagaaatgccccctattgtgttaattctccaaactgggggtttgttcaagtaaggagtaccacactagcatgttaattaacagggaacagcttttctgcatgtgtagaagacaacccctgagaacacaagcacgttaactccctctgccctacttcttcctggatcacccataacattactctctacaatacagagatattttaaagactataattttcctccttccattctcttaatagtttagttaacttccacctatttccttatctttcagtccaatgatctgtctataaataagctgctgtattttcctgatgtaaggtttgggaaacacaaattatccattgtgaaaagaatgtctgtccattcttcctagccttttcaaccaactattcctctttatccctgcttatccatctcgactcagcatttttttcttttttcagtaagggaaaatctaaccactgttacctaaaaataataatagaaaagattcatgttgcaatgacagagaaggaagaaaaacagtatcattctccttcttttcattaattaaaacaatgcttatattaatggcagtcaaagaaaggatatgttttcagttccccaagtaagaacacagctatatgggattaaaatacctgcataactctggtatttgagacaactggcctactatacttatgaaaaactgaatattcagaacagatgtttacaaaaggatcactctggaaggctaacaatttctaaagagaagatgggaatgcactataatttttaccatctatttatctccatggctctccaacttgcctagggcactactgagcggcacttagtagcagtcctgtaacacaggctgatctggcaaggaataacttggctgtaaagtggatgaaacgtcagcaagtacatacaagaccttgtatctgcttagtttcacgcattggtttcctctagtaatggaataacaccctccttaaaaattctttagttttgtttcaaattatatatagttactatactttcttagcatgtttccatcaatctttgacgttcacaagattacgttgtactcacgatggctttttcactagcaaaagtcgcagcatggactttaatcgggtagtacacggaagcatctcttctgtgtcagaacttgctttgcttagaaggagaatgcagttacccagaggatcttctgtgtcggcatagccctaatagatttgtttttaaagagaaattattgtctaattgtatacataacttttcaacttgaaaataagaattgtattgtcctatcagcaactcataaatgtctttggattcagttgaataaaatcattattttttaaaataacttctatgagccaaggagcctaaataaaactgtatttaaaagaaaatacacatacatacaggagaacttcaggaaaacatgccaaccttcttgacacttgctgatttttctattttctaagattctaatagtggcacctcccctcggtgaagcacctcacagatcctcagcccatccccaccctaagaagatggagtgctctaaatgctacacgcatggaatctgtgagtctcaaggcacaaggcccaggctctctcttctaaaagaggactgtgcttatgatggcatttctgaactccaccttttcatccaaaagagacaggaaactgactcctttaatgtccagaaggattgcttttttaaaaaaaaaaaaaaaagctgtttctaggagcatgttaattacggtatcactctaatcatacatatgcatggatagaactcatgaggcaagttagttatgtaaggtctccttaaaaagcactgttagctctgcctaaaagcctttatataaggttgagttctatttttcacagtcaatgctgtgaatgcacctcactttttaacctcccacccagatatataaaatatatacagacaaattagctatcctggtttaactttctgccagaaacaagacagccacccacttcctgttcacttatccccagcgccttcacagcttctcttcatttctctcacaacttgacagtttagctgtttgcatgcatttaaatcaatcacacccagccaaagataaatggtatcataaaaagtgaatttcacagaatacctgtagtattgggatgacaggacagagagattcaataaacttgttccaggtcaatgctgtcatcatcaatcgtccctgaagcaggtataacagaatggccttggcagcagtgttcacctgctcaacaacacagacccgataaaccagtcaaatgagatgtcccgctaggtcacctgacacacctggaacattttatagcatgtggaaagatgctataattaacatctctttctttcaaatgttcgtacttccacagcatcatcttacattctgttctgtttttcttccttaatatttctaattttttacctttaatgtacatttgtcccttgagtaaaaatttccctaactgaaataatctgcttactacctgtactgtatagttctctacatcttagatgaaaaatgtaagtaaactgatctgaattttttgaaatcaagtgtgtcctgtatttttattcccacattttatgtaacatttatttttatttaaataacacttcaactgaaccaatgcaccaaagacaggtttctttttagtttctcaccatgctatctaaactatattagaatatcaccttgatttagctgagtatctaagttactgtaatattttcactcatgtttaatgtcatacctcactttcgggctcttgaatgccaaatacagagatttcatacagaacttttggatgaagtagaaaatgaattccattgcaaagtgaagacacgggtttagtgacattatggacacctaaacattcctgtaaaataatattaaaaagtatttttaaattagcaacactgatttttccaaaagatccatctttcttctgtttacaatcccatttctattttagtttttacttcattgaaactttttttaacaagacagaatgaaaaagattctcctgtctaacagtttcttagtttgtaggagatacatattatattactttctgccacaagcataatcatgataaattaagtaaacaaacggctgagacaaccataatctcttaaagttaattcatcatgacagacacaaaggacataaacacagtaagaaacttatcctaaggtgtttgcattttacttacaaaggttgggaaagaaaaattcaacatgaaaagacttcaaggacttcaagttatgggagacataactttatatactatatatatttatattctatatatatagaatataaagaatacatattttatatataatatacctattatatataattttttatgctacatatttatgtcctatatatgtgatatatatatgattatataaagttatcatcaatacagctatgtacctaaaatacaattactttgaaccaacacttagagtaactatcaggaatttttttctcaatatgtgatagagaatagtattttgttagcagctatttaaggtgagaggggaaaaaaagctacttgaaatattaatggaatttaaatacaatatagaaggtaaaaatacaataaataatgagttacatgaatactactttttttcattctgcaaatttctacttcctattatcaacaattcaaaggtcaaaaagttacacacatacactcacatatgtatttgcatacattatttttctttcaactgttaacttcatgccacagacagcaacttcgttcatattacaaggttttcaaagatctaaagcctcagccctaaacaatagctgtcacctacttccttaagatacttatctaccatctaaactgtgactatccccttctgaaaccaagatttacttcctaaaattgtcttatttttctccagcacctttatttttcttcacatgattattctaatcaccatatgacatattctaatgtgtctatggccctggctttctcctcttgataacaattcatttttcagctctccttcccaccacgagtcctcacaagagttcgctgtcctcagtcagtacttcctcatttgccaaaccctcttcaatgcacatcagcaggacttaggttcctaccattccacaggagcttctcatagaggacaccaacaacctcaacgatgccaaatccaacgtgttcatctctgttctcatgtgactcttccttctaacctctgtctccacttctggctccctctgttcccaacttctaactggttagatcctagacagccttctcttccctagtctctcagtagttgatcctatcaaggcttgtggctttaatatcatctctaagctgatgactgaaaattttatacctaatctgggctccacactccaaaggtagtgtggtgcaatgcttaagaatatgggctttggagtgagcctatagggttcaaagcccagtttcaccacttttagttgaatgaccttggacaaattcaaagtatctccgttttcagaaagaggtagtacctagctcacagagctgttaggaggattcaatgagataatatacttataaaagtacttgatacataagagtaaatgctcaataaatgttagctgctatcattatcaatgaaattattagcattagcattattatatttaacagtctacttaacatatgcacttgatataaaaaggcatgtcaaacttaggttcaaaacagaattctacccaatccacaatcccatatttgggacatcaatccaactgctagatccaaaaccttaaaattcatccttgatcactctctatctcctactctcattatcagcaagaccaattagctccacgtccgtaatacctcctaaattcatttccttctcttcatctccactacaccaccacatctcatcagggctactacaatgaaactggtcttcttgcttccatcctgaccccctacaatccattccccacaatgggagagtgatcttttcagaaagatcatcagatcacgttaaaatcattcatagcatctcactgtacttagaatacaattcatagctttataatgtttggcaccctgcctacttttcagacccaatctggtaccatttttctattatctcattatactgcccttctttttgttcgtgaaacacgcaaagtacattctcacctgaaaagcagaggcttttcacctgttgtttcctcgggctagaaattctccctccctccctagccagcctacataaatttagtccacgttactagtcattctctagtcctttatcctttcattgtctttacaacactattttatttaaaacactatatacattgaatgtatatgcagtgttgtaaactatatatatatatacatattctatacatatagtgttataaagaaaactatatatacatatatacacacacacatacacatacatactttttatgtatttaaggaatttttcttaattattacatacatctctctctgtcccctatcagaatataagctctctgataaggctcttttctgtactttatatcactacagtctagcatatggtaaagtgtccagtaaatattgctaaatgaatgttagatgtaggtaacatggaagtggtggccatttaatcatccctaaatttaaaagctattttacctctttaccataccgtcctcaaagttaagtcttacaataaaaagctaacttgcctcttcagaaaaagtaacctccacattactagcacgctcctacatttaggtaggtaaagctgcagcaatgccttggagatttaccagaagacactggaataatatcatctgacagacatagccaattaaagtgaaatgcctttacaaatccttatatccaaaccaagatactatatctttatgacacaggggctaactacaagaaatctcatcatttggagcttttgacttggattattataactccctgatagtaaatacacatgaattttttaaaaccacattgcactatacagatgattatcttttgtgacaaaagaaaaatcacaatattttgcaagaacagtgtcaactaatataaatttccaaatagttaacaagaaaataaaacattaaatgaaagttcacattcttttattttatctccttctacaactaggataataaggcgagttttaacaaaaaatattctttcagtttaaattttgcaacaaaatgtatgacacttggttataaaaactatagtatattaaaatttagaattttcaaaattactaaaattcagtgcattttttttaaaaacaaattcgaaactgacacatacatatttatttctgacattccttttttcctatcattctatgacaggaaaaattatctggatgttaattttttagaactcctctaaaaaattaacatccagattattcctacttgaaattcatcatataccaaaatgatcatatacatcaataactcaatttacaccaaatattttcctatctgcaaaaatttttatttccaataattatttaaaatctgcctcaagaaagatatcaaatcgtattccaccattttaaatttcggggtataataactatcccaaatacagtgatcttagtttcttgacctatttatctcaatgatactcacctgccctataactgaggaccccttctcttttcacttgttctacctctaaaatcataaatgtaggtttctaatcttcttactcaacttgaaatatggtccttctttgacctccagtccataaacccttctactttcttccctgtagtctttacagcctttggttctacagtcgacatgtcatttcaactactcagctcacttgcaccacaggcattccctcctccccgacagcaatgaaataactcaacccttgattgatcgcaaggttcacattcccagaaaccacaccagctagccaaagataaacatgcaaagtagaagagtctccctattaagattatagacacaattgactaagctcttcatgcagcccaaaaatgctactatttgatattatcaaatatctactcatattagtcatttcacacattcaacatctcactttcaatctcaaagaaaatacagactcaatagaaggaggctcctgcaacttcctgtgatatctaagcccacctaaccccaattagccatcatgttcaaggtcccaccgccttcaactttcaaaggcactagcttcttttaattagctacttgctacccactatcttcaatctttcctcctctgattctttttattatttcaacatacacaaatgaaaatgtaacttcattacaaaccccttccaaggtgcatcaccactaactgtcaaatccctaaaggcaaggcagaaacaaatatacaaccaccatctagagaatacaagatcacaagaaaaagctaccctgccaaagaagacctgaaaatcaaaataacagtatctgctaaaataaacaacataaggaagattcaatagccataacaagtgggaggattctaataccataatctaaacaagattataaaataaatatgtttaaaattcacaacaacacaaaagaagaaactagaggacttgttcctggccttgagcagctcttagggaagtggcaagtgcaacaggcatggagcagcccactcttgcaacgatcctctaggatcctaactatgggagaccccatgacctgcacagacctttgagttgcaagggagaactgcccaatgagttgccagagacagaatgccagtctgcacagagcccagagggtctggcgcagtaatggctgcaatggggcatggccataggtgcctgttgcgggaagtcagggaccccgaacggagggaccggctgaagccatgggagaagaatgtggattgtgaagatttcatggacatttattagttctccaaattaatacttttataatttcttatgcctgtctttactgcaatctctaaacataaattgtgaagatttcatggacacttatcacttccccaataaatacgcttgtgatttcctatgcctgtctttactttaatctcttaatcctgtcatctcgtaagctgaggaggatgtatgtcgcctcaggaccctgtgatgattgcgttaactgcacaaattgtagagcatgtgtgtttgaacaatatgaaatctgggatccttgaaaaaagaacagaataacagcaacgttcagggaacaagagagatcaccttaaactctgactgccggtgagccgggtggaacagagccatatttctcttctttcaaaagctaatgggagaaatatcactgaattctttttctcagcaaggaacatccctgagaaagagaatgtgcccttgaaggtgggtctctaaaatggcccccttgggtgtggccgtcttctatggtcgagactgtaggggtgaaataagccccagtctcccatagcgctcccaggcttactaggaagaggaaattcccatctaataaattttggtcagaccggttgctctcaaaccctgtctactgataagatgttatcaatgacaatggtgcccaaaacttcattagcaattttaattttgcctgcggtcctgcggtcctatgatctcgccctgcctccatttgccttgtgatattctattaccttgtgaagcacgtgatttttgtgacccacaccctatttgtacactccctccccttttgaaagtccctaataaaaacttgctggttttgcagcttgtgggacatcacggaacccaccgacatgtgatgtctcccccggacgcccagctttaaaatttccctcttttgtactctgtccctttatttcccaacccagccgacacttagggaaaacagaaaagaaactacgtgactattggggcaggttccctgataggtgcccatcacccaaatcttgatatactcctctaggtggctttagccttagttcgctgccagaagtagaaagagcagggctatctttcccacaagactgggccaacctgatctgaatgccaccctgtctgccagcctctcaaagggtcctgtctgtctcactagcttgcaacacagcctcagctgccctgccgaaatgctccccaacagccaccccataggtcttttgccaacagcctctgccttcctgtcagagcgcttttgcaagcacacacccacccacagccaatacctactggtgtgcacttgcctgcagcctcccctgccagtgcgcacttgcccatggttacccccaccacaagtgcactctcccaaagcaccgccccacgcccccccagagcactttctcgggcagtcaccatcggaaagttgttgccagcagtctgggaacatctcggctcctccagtgcagcagatgcttgacctcaagggaccagaaatcaaagccactggcctgttcagtgcacccccagggttagagcacacagcccaggggtgctgagctgagctctggccctgaaagcacacagaaaccaagccaattgactaatcccaacttataccacagtaaaatcctcaatggcatcaaataatataaaagcaaaaggccccatccaaagtacagcaacttcaaagattaaaggaacatctgcccacacaggtaagaaaaaaacagtgtaagaattctggcaattctaaaagccagaatgtcttcttattttcaaataaccacactagctccccagcaatcgttcttaaccaaactgaaatggctaaaatgacagaattcagaagctggaaggcaaggaagctcgacaagatatagaagaaggctgaagccccacccatggaaaccagtaaaatggtggtttgatccatgattggatctgacacaaacattttaagtaagaacaaaactgaacttctggaaacaaaaatttcatgataggaatttcataatgcaattggaagcattaataacataactgaggaaaaaaatctcagagctcaaagactactcctttgaatcatcacaggcaaacagaaataaagaaaaaagaattaaaaaaaaaaacttcaagaaatatgggattatgtaaacaaaacgaacctaacacccatcagcattccagaaagagaaggagagagagcaagcaacttggaaggcatatttgtggatattttccacgaaaatttctccaacctcactaggcaggtcaataagcaaattcaggaaactcagagaaccccagtgagatactattcaagatgaccacccccaagacacatagtcatcagattctccaaggtcaacaggaaagaaaaaatcttaaaaggaagctagaaagaaagagcaggtcacatataaaaagaactccatcaggctaacagcagacctttcagcagaaaccttacaagccagaaaagattggggacctataatcagcatgcttaaagaaattcaaaccaagtatttcatatccagccaagctaagcttcataagcaaaggaaaaacaaaattattttcagagaagcaaacgctcagggaattcattaccatgagacctgacttacaaggggtcctcaatggagtgctaaaaaaggaagcaaaagaccattacctgcctccacaaaaacacactaaaatacatctcccactgacactatgatgcaactatacaatcaagtctacgtaacaaccagctagcaacatggcgacagaatcaaatcctcacatatcaatactgaccttgaacataaacgggctaaacaccccacttaaaaagcacagagtggcaagctggataaagaaccaagacccaactatatgctgtcaagagacccaactcacatgcagtgacacccacatgctcaaagtaatagaatggagataaagatctatccagcaaacagaaaacaaaaaaagagcaggagttgctcttcttatttcagacaaaacagactttaaaccaacaatgatcaaaaggataaagaaaggcattacataatgataaagggttcaattcaacaagaagatttaactatcctaaatataatgcacccagcattggagcacccagtcataaaacaagttcttagagacctacagagttttagacaaccacaaaataatagtgggagacttcaacaccccactgacagtgttagacaaatcactgaggcagaaaactaacaaaaatagttgggacctaaactcgacacctgaccaaatggacctaggagactctacagagtactccactcaacaaaagcaaaacacattcttctcatctgcacacagcacacactctaagatcaaccacacactcagctgtaaagcaattctcaacaaattcaagaaaaccgaaatcataccaaccacactctcaggccacagtgcaataaaaatagaaattattaccaagaagatctctcaaaaatgatacaattacagggaacttaaacaacctgcacctgaatgacttttgagtaaagaatgaaattaaggcagaaatcataaaattctttgaaactaacaaaaacagaaacacaatatatcagaatctttagaacacagctaaggcagtgttaagaggaaactatacagcactaaatgcctatatgaagaagttagaaagattgcaaactaacaacctgacaccacacttagaggaactagaaaagcaggagcaaaccaacctgaaagctagcagaagaaccaaaatcagggctgaactgaatgaaactgagacacaaaaattcacacaaaagatcgacaaaaccaaattttggttctccaaaagaatatacaagattgatatatcattagctagattaataaagaaaaaaagagacaatccaaataaacacaatcagaaatgacaaaagtgacattatcactgaccccacagaaagaccctcagagaccattaagaaaaactctatgcataccaaatagaaagcctagaagaaatggataaatttctggaaatatacaaactcccaagattggaccagaaagaaattaaaaccatgaacagaacagtaatgtgttcctccaaagttgaatcagtcattaaaaaataaaaaaagcctaccaaccagaaaaaaacactgggccagacaaactcacagccaaattctaccaaatgtaaaaagaactgttaccaatcctactgaaattattccaaaaaatgaaggaggagtgactcctccctaactcattctatgaggccagcatcatcctgataccaaaccctagcagagacacaacaaaaaaagaaaacttcaggccaatatctctgatggacataaatgtaaaaattctcaacaaaatattggtatactgaaaccagcaggacagcaaaaagctaatccaccacgatcaagtatgccttatccactggatgcaaggttgattcaacatatgcaaatcaataaatgtgattcatcacataaacagaaccaaaaagaaaaaccacatgatcatctcaacagacacagaaaaggcttttgataaaattcaacattccttcttgttaaaaaccctcatcaaactaggcattgaagcctcaaaataatgagttatccatgacaaagccacagccagtatcatactgaacaagcaaaagctagaaacagtccccttgagaaccagaacaagacaaagatgccaactctcaccacttctattcaatatgctattggaaggcctagccagatcaatcaggcaagaaaaataaaaggcatccaaataggaagaggaagttaaactctctctcttcacagatgattctatacctgaaaaaaaaaaaaaaaaaagaaaaaaccatattctctgcccaaaagttcttagaactgataaatgacttcggtgaagttccaagatataaaatcaatgtacaaaaatcagtagcatttctgtactccaataacatccaagctcagagccaaatcacaatgagaattgtaaaacactgcagaaagatatcagagatgacacaaatggaaaaacattctctgcttatgaataggaagaatcaatattgttaaaatggccatacttcccaaagcaatttacagattcaacactattcttatcaaactaccaatgtcattcttcacagaattagaaaaaaccattctaaaatttatatggaaccaaaaaaagagaccgaatagccaaagcaaacttaagcaaaaagaacaaagctggaggcatcagactgcctgacttcaaactatactatggggctacagtaaccaaaacagcatggtactggtacaaaaacagatacacaggccactagaacaggttagagaacacaaaaatatagccagacacctacaaccatctgatctttgaaaagacaacaataacaaacaacggggaaataactccctactcagtaaacagtgctggaataactggttaggcgtattcaaaagattgaaactggacccccttcctttcaccatatataaaaatcaactcaaaatggattagacttaaatgtaagacttaaaactataacaaccctaggaaataccattctggacacaggtcttggaaaatatttcatgatgaagtctccaaaaaaagcaattgcaacaaaaacagaaatagataagtgggacctaatgaaactaaaaagtttctgcacagtaaaagaaactatcaactaagtaaaaatatcaactaagtaaaaagcctacagaatgggagaaaatatttgcaaactatgcatgtgacaaaggtctaatatccagaatctataaggaacttaaatcaacaagtaaaaaacaaataaccccattacaaatgggcaaaggacataaacagacacttctcaaaagaagacatacacacggtcaacaaacacatgaaaaaatgctcaatatcactaatcattagaaaaattcaaatcaaaaccacaatgagatatcatctcataccagtcagaatggctattattaaaaagtaaaagaataacaggtgttggcaaggttggagagaaaagggaacacagtactataagccctatacactgcttgtgggaatttaaattagttcagtcactgtggaaaacagtttggagatgtctcaaagaaattaaaacagaactaccatttgacctagcaatcccttactgggtatagacccaaaaaaatataaatctttctaccagaaagacacatgaacccagatgttcactgcagcattactcacaatagcaaagacatgggatcaacctagatgcccatcaacagtggattggataaagaaactatggtacatatacatcatggaaaactactcagccattaaaaaagaataaaataatgtcttttgcagcaacatggatgcaaccagaggccattatcctaagtgaattaacacagaaaaaccaaatacagcacattctcacttagaagtgggaactaaacactgcgtatacacatggatacaaagatgggaacaacagacagtggggcctacttcacaagggaaggtgggaagagaacgtattagcctattctcacactgctataaggacatacccgagactgggtaatacataaggaaagaagtttaattgactcacagttctgcatggctgaggaagtctcaggaaataatcatgtcagaaggcacctcttcacagggcggcaggagagagacagaatgccagcagagacaatgccagatgtttataaaaccatcagatctcatgagaactcactcactgttagaagaacaggatgggggaaactgcccccatgattccaattacctcctcccactgggtccctcccacgacacgtggggattacagaattacaattcaagatgagatttgggtggggacacaaagacaaaccatatcagagggtgaggatcaaaaaactacctattgggtactatgctcactacctggctgacaaaatcatttgtacaccaaaccccagcagcacacaatttacccatgtaacaaacctgcacatgtacccccaaccctaaaataaaagttgaaaaaaaaaaaaaaaaaacagaaactaatgaaagattacatgaaaaaagaacaagtcagttaaagaaagcaaagaaaaggtatagacatgaaaaacagtataagtgataatcaaaacttgataaatttaaaaaaaactatgatgggaaatgactttgcacccattaggatggttactattattaaaaaaaaaaaaaaaaaaaaaaaaaaaaacaaggccagacacggtggctcacatttgtaatcccagcactttgggaggccgaggtgggtggatcatgaggtcaagagatcgagaccatcctggccaacatggtgaaaccccatctctactaaaaatacaaaacttagctgggcatggtgatgcacgcctgtagtcccagctacttgggaggctgaggcaggagaatcacttgaacccgggaggcagaggttgctgtgagccaagattgtgccactgcactccagcctggtgacacagcgagactccatctcaaaaaaaaaaaaaatccagataaaaagtattgccaaggatgaagagaaactggaatccttggcactgccagtgggaacataaaatagtacagtcactgtggaaaacagtagggcaattcctcaaaaattaaacacagaattactgtgtgatctaccaattccacttctgggtatataaacaattgcaaaaagatggaaacaacccaaatgcctatcaacggatgaataaacaaaatgtagtataggatgagtgtcccttatctgaaatgcttgggaccagaagtgtttcagattttgaaattatttggatttcttaatatttgcattatactttccagttgagcatccctaatctgaaaattcaaaactggaaatgctccaacgtgcatttcctttaagtgtcatttcggcactcgaaaagtgtcagattgtggagccttttagattttggattttcagaattggagtgttcatatatacagacaatagattattattaagtcttaaaaaggaatgaaatgttgatacatgttacaacatggatgagccttgagaacattatattaagtgaaataagccagtaacaaaaagacaaacactgtatgattctacttatatgagttacctagggacctcaaattcatagagacagaaagtagaaaggtggctgtcaggggctgggagaaggggagaatgaggagttattgtttaatgactataaagtttcaatttgggagatgggtaatggtgatgatggtacaacaatacgaatgtacttatgccactgaattgtacactcagaacatagttaaaatggtaaaattttttccttttttttttttttttccagaaatgaagtactcactctgttgcctaggcttgagtgcagtggcatgatcacagctctctgtaccttgacctcccagtctcaagcaatcctcctgcctcagcctcccaagtagctgggactacaggcacatgccaccatgcccagctattttttttttttttcttgtacaaacaggatttccctatgttgcccaggctggtctcaaactcctgggctccagtgatcctcctgctttggccttcccaaatgctgggattacaggcatgagccaccacacctggcctaaaataaattttatgttatatatacatatcaccatcaaaaaaagtaaattagacaaagctgaggaaagaattagtgtactgaaaggataacactgagaaattctacccaaataaaacctaaaaagatgtggaaaatatgaaagaaggcttaaaagacacaaagggtaaactaagaaggtctaacacaggtctaataagagttccacttggagaaaacagcaaggataagagaaaagcaatattcaaaataagcatgaccaagaattatacagaagtgaaggcagatggagtgttcaaagcgaaaagtcctaagcaagataaatggaaaatcatgtatgcatggagacatattttaatgaaaccgcagggcaccacagaaaaggaaaatattttaaaacaaactagagaaaaaaattaaaagaaatcataattaactgatatcagacttctcaacaatgatagaagccgaataagaattaagcaatactggcaaagtgctaataaaaactagcagtcaacctgtattttatatgcagccaaattactattcaaaataaagtgaaatcatgacattttcaaacgtatgcacacagtcacagactgtcactgaaaatactgaaaaacttacttcaataaaaaggagactgaacctaaatatttatcattcaataaaaggaagtatattcaaacttaatagcagttaaggtgaatgaactaggcaaatctcaaatcctgctatatatactaatcatgctatatataaaattctttaaattatttaaagataatatttatatataaagatacagctttataaataatatacaacaactggatgggaagaatatacaccagctgtgtaagagtggctaggctatgctggtgggagaagagaaagcaaagaagcttcctctataactagtatttttctttgaataaaaatgaatcagaagtaaaaatggcaaaatgtaaacacttattataaccaaatagtacttacaagagtgttaaatacaaaaggacactttcaagagtacgcagtaatatatatacttttaaatattgtcctatgtacagtgttcttttcaatattgaaatatttaatattctatgctgaaatattttatcatttaagaagacagaaaaataaatatttcaaaagaaaagaaaaataaaaaataacattaaaaaaaacagaattaaaaccataaaatctaggccacaacaacctaaaaggtttcctgggcatagaaatcacttttgaatacctggaaatcaattttccttataatttttccatcattaatacaacataaatgtaattcttaataaaacttcaaataaagcaattcaattgctggacttactaagttaagagaatttaatagtacaaattttccagaattgactagtaattatcatctacttttatgggatatagttcttatatctcatacaaaaggtcaagtaaattaagtttgaaggtataacaagagagtctactatttgttctcaaaaacaaaacatacgaaaaaacaaaacctcaccttcgtgatttccagacagcagtggtaagtttcagctttcactcgtggcaatgggtgagacaacatatggagaagcaccttctgactttctccttgtagtaatggactggcctgagcagatttccagctggtgaaaaggtaaaacaaccaagacatgtgaggcaagtaagttagtaagcaaaagactgcaaagcatactggaagggatttcttcctactccaactcctcaaactgagatcttattaaaaataaccaatactagcaagtactcacctaagcacttatttgtttcagggcagaggaggttctgtcttaaagagtatttttaaaaacccaaaatgtctttaaaatcccctactcagttaatgattatcacatcacagaatttattctttccaaaagcaataaagacactaagttctaaatagaaatttgctgatgtcctcaaaataaattaaccaatacacagtcttttctaaaaatccacataagaaaaaggtacaaagtaataaaagttacaaaactctcagtttaagttattaattaaaactttaaagataaataaacaatgtgtgtgaatagtctggatggataccaaaaacaaatgtataaaaatccaaggattattcattttgattgtaggcatgacatttttgaagtttaatcttgaatataacagttaagtatcctaatgcagctgtacatataccctttaaaaatcagacacatataaaagcaattaaactaaaaaataataacaaagatatacagtcagtttcactttcactgtttctaagtttacacacaccctaagtgtccaataataacgtaatcacattaagaaagaaaatattacatctttgaacaaatgctgatgatttcctttattagcgggaaatgctgatgataggaaaagctacgcaaggcttggtctgccagctccactaattctaagagattcttctctccctacaaaagaagcagaatggaacaataaatgtcaagttcatgtgcaatgatattctcaacagctaactaagcagcttcaagaaattagaccattcagagaccatgagactgtttacatttgtttaagtccactttctcatcaagcaacctaaaaatgtcagccgaggtggagaaatgtaggaaaattccctagctaaatgccacatgagactttctattatttaactctgagtaagcttaaagttacaatcaagttgcctggttctttgattacttctttgtagctctacctcccctaataaaagtagggctaatgtatttattttattataaacctgcctcttgtagcagcctgaccactaggaacacacaggacattgaacacatgtgtgattaactgaccacacaaaatgccacagaggccagacccagtggctcccagcacttcgggaggccgaggcgggcagatcacttgaggtcaggagttcaagactaacctggccaacatggcgaaaccccgtctctactaaaaatacaaaaaattagctggttgtggtggcacgagcctgtaatcccagctacttgagaggctgaggcgggaggtggagcttgcagtgcgccaagactgcaccactgcactccagcctgggagacagagtgagatttcgtctcaaaaaaaaaaaaaagccacagaaatacttcaacttaaagacacaattcaaaattctatcacagagaaaacaagaagacagtggtactaacatggcaaaaggaaaggggaaaaaaaacaaactacagtggtaagtaagaaaaatcataaatatcaagttcaaggccaggcacggtggctaacacctttaatcctagcattttgggaggccaaggtgggaggacagcttgacgccaggagttcaagaccagcctgggcaacacagtgagacctcatctctacaaaacaatttaaatattagccaggtgtggtagcatgtgcctatagtactagttgcttaggaggccaaggcagatggattgctggagcccaagagatcaaggctgtagcctaggcaactgagaaggctgtcaaaaaaaaaaaaaattcaaagaaaataaataggttcagatagattctactgtaggcaccaaaatgagtaagaattttatccctaattcttcaagatcttcaggatccatgtccttattttcaaacaataaacaactcttgtatcaatgtctgtctctaagacccattaaccctttcattgataacatactaatattctaatagtatttttaaaagggataaataccgacacataattattgctgtaacactgccataaagtcatcctaatacattataaacaatgtagttcatcactgtacttaatatatttcaaaaatcagcctttatatatatgtaagaactatctataaaatattgaggcaaaaatatgtctacaagtaagcactaaaatagcccttataattttggttacatcaactgtcattcagttcatatcagtaagtcacttaatagaggtactcattattaaatattaagacatttgtaataaccactgcttttttgtaaatcactgatgttaggaatatacaccattaattaaagtcttcgttttacttctatacaaatcatatccttactttaacctgttaaataacaggttatgtataattgacccactcaggaataatgtatcccacctgtgacaatttaattatatgtccatcaatttgaaaagtatagattaaattttcaaaatatgtcaaagggatttaaaagagatattaaaaaagctttttacctctttcccaatatcagacaggaagttacaggtgcattcaattgaataaacggcctctgcagttcgtttataaatactgtagttttcagaattcagctgttccaaataggccacaacagcttcatgaatatttggatattccaaagaaataggcatgtccaaagaaaggagaaataatgctgttgacataggctctgataaaaactcgcttgccttggtgaattaaaaaaacaaaaaaattaaaactttgtttaaaaaaaacttattttagagaaacatagtgggctatagtcttaatctaatccaacttcctttttagcaattctttgtcaaaaaactgaaactttttccaaagaaaatcccatttcccaacacatcatctacctctatctctgtcttttttcaatacaaaatgtctcaagtccaaatatcaactctttctcaaagcctaagatactaactactttcttcttccccaaaccaacttcttctctccttgagccctgcaccttgtatatacctctgctattgaactaaggcatgaggcctttttctctaagtattttctgtacatgtacgcaaatctccccaataacctgataaactgaagacaagaacacttccccatcccatagctgaacatgacagagcttattaatgacatattaataacacgaaatcaagtatagctatagattgatttgaacagaaacgaatttttttctttggttttgtcttttagaggggatagtggaaatccaatataatattttaaatagttctaaaatacagaagatagccccttaattagtataaaatcaatatgcccaaatgaaatattatacacattataaccttaaatcaatagatttaaaactgaaagaattatggtttttaaaaaaatggttctagttttgtgacaggattctaaatatcaattaaaggaataaaaaggactaaaaatttgacgttcagagaaaatctcttgacaagactcactattacggctgaaatgctgtctttacaaaagtgggtttggtcatgatttatttcatggataacctatttcaaggataatcattaactacctgaaagtctaagagctgaatcagctaaacaacgatacctttaaatgaatatagttgctaaatgaagatcagaaactacagaaatcaaaattttagattacacagacatgacaaacctccagattagtaaaacagcagctattagaaagtaaagagaaatttcattattctgtgaagaactttccttttttttgtgggcgggggaggaaaaagagaaactcaattatctgctcacctattattcactcactcggtgaatattaattaggccttactatgttcctccactatatgccaggtacctctccagtcctgggaacccagcagagagcaaaatacaacctctgcccgcatgaagctcacatcccactgaagaaagtagagtgtaaatcgatatacttcctaagatgttaggtgtggctaaaaagtgttttaaaacaggataggaaagatgaagaggaacagagaagtaatggggagtggaggcagggaactgctacttctccaaagtagtagaggaaggcctcgctaataagatgacatttaagtagaaccctggaagggtcaggagccacgtggctatctgagggaaagcatttatagaagagggaagagcaattacaaaaactattatttggtagcaagaaagccagtggagctggttctgagggatggagtcagaaaggagtggtgggccagatcagttaaggctttgggtcgtcataaggaattgtcctctgctgaaagccactggaacattttaaacaagtatcaaaattggtctgtagagaactgatggtaatgtgcaaaagtggaagctaagagacagaggactttactgcagtaatccaggcaggacagaatggtgggcttaactcaggtattcagattctgtataggtattcaagggagaaatgacaaattttgctcagggattatatccacatatgagcaaaagaaaggaatcaaggctgactctaaggtttttgcctgatcaacgatcaacttgaacaacaaagttgacatttaccgagacaggcaagactataggaagaacatatttggaaggggaaacaaagaatgaagtttgggacatgttcagttggagacatttattgtcacccaagtgaagacatcaaaaaggacactggatacaggtaagttcagagttcaggttatatgtctggtctggaagtataaatttggcaggcatcaacaaatagatggcatttaacaatcacaaatgggatatatttcatgagggctactgtcagtcctggggttccactcctgaagagttaggaagataaagagaaattagcaaaggcgatttacactgtgctaagagagtaaatcctaatggatctaactctaaaggcactgtgttctagtttaagagagttctctctgactctagtcagaaaaataacagctgctgtgagaattaaacaagcattaagcagagcatatggcatatagcactcaataaatattaatttccttttctcgcttcaccacaaaggaattccaatgtttcaccctgcgtacttgtatttgaaactcttgctatctcaacaactcaaagccccatgctaatgtcattagctaatctttacatggcccaatggactaatcacaatttacacccctaatctaagatagctgtcctgcatatataagcattagtcacatgccatcagaactaaaagtgaagatgtttcagtgcaaatccatcaccccattagataaaaaataatcagcaacatcacctcatgtgcattgggaggaggggctataaatgtttcctgtaaactagccactcagcagccatggcataattctatgagtctgttagaaatgccggctctcaggccctaccctttacctgatgaatcagaatatgcaagatgtgattaacaatatctctaagtgatctgtttgaacattaccgtttgaaaagcactgctctcagtcactcaactggcttcaccaggtcattagatctttttatatacctccctgaaaagctaaagaccttgtgttacaaattcttccttagccttggtaagcatcactagctaagagtaacagcagttcctagaatgctctgtgcttctgcttccagaacagggctagtacttttagctcttacttcccagatgtttccccaaatgaaattaccttcatttgttttaccaatttagtttactcaaccacaatatttttcagaagattaccaacgtatcattttaacctatacatgagtattctccaaaatcatttaatatcaacaaatatcagtttcaaaacaggcatcagaggacattttgttaaacttaggaaatctctacatagattcatatttattttccaacatccaaactacctacttggtcagtggcaactcaaaaaaaccactttaaaggcaaaaagtttcagagtccaaattctacttcaattattagtgggctagcaacagacagagggcagcataaccttacatttatataaaccaaagaagaaatttaacatcaatgaaatagcatttttgtttagatctcattttaaagtacttagtcaattaatcaaaacaaatataatcatctaaaaacaaataccttaattacaatctcccacaatgatcaaaattgttttaataaagttccaagttatatatttaaaataactaccaaaaattagataattgatttgtttttaaaaacggaaacaataaaacaataactacctttaaaaaaaaaagcatggaaaattaactttacattattctggcactaagtaaaataaattactgatttctttttggttcctgtccaaataagcacatagatgaaaaaatacaatcaaaaactacatgatgcaactgataggataagttttccatcaatacttcgacccatagatagattgaccatttgcaatacttaatagcaagcaattgtagcaccactaatttttcatttatataatattaaggaagacacccatattttaaattcaattcctttcttaagagactggaattcttccattcttgatgcttatgccttgaaaaattgtcactcttcaaaacagaaaaggacttcagaaacataatgactagtgaatacaagttaaaaattaaaagtaacacaagtgatgttattttccttaaagcaaaatactatatttaaaatgcagtgttttatccgttttcctggatcacctgataatacattgtgtatataagtgatacttagaaaatggagtttgggccaggcgcggtggctcatgcctataatcccagcacattgggaggccaaggcaggcaaaacaagaggtcaagagatcgagaccatcctggctaacatggtgaaacaccatctctactaaaaatacaaaaattagccgggcatggtggggcacacctgcaatcccagctactcgggaggctgaggcaggagaatggcttgaacccaggaggcggaggttgcagtgagcggagatcacgccactgaactccagcctggtgacagagcaagactccaactcaaaaaaaaaaaaaaaaaaaagaaaatagagtttggactatatgctctacagaattctaggaaacaaagctgcaaatgtttaataactaagggcaacaaagaggcataaggaatagttttctagttttcataatttctcccatacctgcattttagtgtgtcactcctttgttttggtaataagtacaccacgaaacactgatgtctgaatgatctgagatatttttaccactaacattcaaattcagagataacctcacgtttaaaaatacagtcagtaagaagattttaaagaaatatttacacatattaaaatcacttttaacagacttcatacaatggaatattttgtaataaaagttaacaaattaatgctataggcaacaatagttatgaacctcaagaaggagttgagagagtacatactttataatttcatttaaacaacattcaaaacaggccaattgatctatagtgacagaagtcagaaaggagtgtggcttggagaaggagggagaggtaacagagaaggggtctttggaatgctggtaacattctattttctgttatgggggtggtcactttttaaagacagatgcattcacttagtagaaaaagcactgaactatgtacttttctgaatgtatatgaaagtttaaaaaaaaaaaaaaaagcctttacagaattaatgtttttttctgatagcattttaaaaatcatttaaaaatttaagtgttctagttaaactaacagtgcacaatttcagaaactgtaattggcaaacacacagaagagacaccagccttaggcactttcaaaaagtgcttctttttagtaatttcccggccatatattctcacaattatcttttccgtgtactactctttttatccattctttagttaaaaacaatgaaactcgtgaaactataatatttttaaattatgcttataataaaaacatgtttaagcattcagcctttgaactagtaatgccactaggaatttaagaatccaaaatatgagtaaacatgcgtaagtagcaattcagcatagtgttatttatcaaaataccaaaaaaagaaaaaaagaaacctaaaagcttaatttctggaatacttgtggaaatcatagaacatcttgctggtaaaatattagtacccattaaaatttatgaagtgtttaattaaatggaaaatgtatgttagataataagaaatggttaaaaaaaaaaaaaagagaataaacaggccaggtgcagtggctcacgcgagtactcccagcactttgggaggccgaggcgggcacatcacctgaggtcaggagttcaagatcagcctggcaaacatggcgaaatctggtctctactaaaaaaaaaaaatacgaaaattagctgggtgtggtggctcacacctataatcccagctacttgggaggctgaggaaggagaatcacttgaacctgggaggtggaggctgcagtgagccaagaaagtgccactgcactccagcctgggtgacagagtgagactccgtctcaaaaacaaaaccaaaaccaaaaaaaaaaaaaaaaaaaaagaataaataacttttatagacgctgtcaattggacttaaagcagaaaagaaaaaagcctcaaaactaacttgaaattataaatgaatttttattcttctttgtacatcaaaatgttttttaaatgaacattttattttctgaataaaagttaaaaactgaaaacaccaaagcttaagaaaagaaaggtctaggtaaaatagaaaagtaggaaaaagaaaagtactagaataaagactagcacagaagatagtttattgctatcatgggcagaaaagcagctttgtgaaagacacctaaagcaacacgttaattaaaaaaacaactttcaaaagacatactaaggtatgaaatcatatattacgtaactcaaactacaaatatggtttagacataaaacaagttaccaaatattaactagatgaatcaaataaaaatcaggatatttaatcctaccaaagatgacttctgaaattcttttgatcaggtgctaaaataaaaatattaagcaattaagttgctgacagaaaggaaatagtgggataccttcaagagaaatgcatgggaccaaaaaaaaaaaaaatcccttaagttactaaaatatgcaacacaccagcaatatacataaagtacaacaaatacaagaaataggacagtcctcagaaaccaacttgaccaatacttagaaactaaagcactgctaacagtattttgaatagataaaacaagaaaaagaaaaggttccatgacattaagatatgctaactataaaataatttctggagcagcaatggaaactattgtttgtattctgtgtgtcaaggaacctgggaaatagtgaataagtaaagaactctgacaacacgtacctagctgaagagaaggaaaggctactcttgatattaatgataagaaccaagacacacactgcagagataagatcagtaggctttcaatgccctccaatcaattaaaagatacaagtgtaccaattatatatgtatatatgtatggaaaaatgtattcgtatattaagacataatctcttccctcaagtgatcccaaagttattaaagaaaccaaagaagtcaaacatatacatgtatatgtatatgtatacgtagatgtagatgtagatgtatatgtatatgtatatgtatatgtatatgtatatgtatatgtatatgtatatgtatagataacagccaagtcttgtcttttacaaaactaagttccatgaggccagggactaattctaacctattcagttttacatccagcaagtaatactgttagtccactgtaagcaatcaataaattattcactgaatgaacaaggaataaacaaacgtacagactgcaataaaacatatgcaataaaagcaacagcacgattaaaaaataatttcccatcaaatgatttgtcaaaattgttcaaaatgttagccatttctcaatttctacatttcccatataacctgttacacttattttgaaaatggcctaaagcacaataccttcacaccatgaaaagagcagaagaaatttacaacagagcatttatttataatagtctgtaaagtacaaatgagcagcattgcctgccttaccttttcaacagggagaagcgtttgtagcagtcgaactgcaaacagggaaatgctgataaaggccattctgtggtgcacaagcatcacctctggctgctccaaactgatactacttttatggtagcacatggtttctccaagggctcccaacaccaggagtagtttctccttctgaaaacatttacacaacatgaaacagaagaaaacaaccaattttaggggccagtatacaaaagccatggagaacagtttaaaatattatcattttcattaaataggaaaacaaatcaaaacagaatttattcctgtgagaattaccaatgcctgctgacataatttaaaaagcacaaaagaatgataaaccacctacattttaaaaatacaataatcttttaagtatttaatatgatgaatcttaacaatgaataaatacaaacaatagaatataaaaggtaaatgaaccataatttcctcctagtttctagtgcctaattgttccaatttggaacgttaacacgcaaacccctcgtcaagtatttcttatgcttactatacgcctaacacagtggcaggcataatgaaagaacaatgcattagtacaagagacatgatgatctctgtcctcaaattgataccaacatttctaaagaaatgcatcaaggaaagtcaaataattaaaaaacaattaaatatcaaattttataaactctctttagataataaggtttcaagtggaaaatgttatgccatcataaatttaaataatttactacttcaagagaaatcatatcttttaaactaaaaggtatacattaaatatgaagaagaatctatgcatagtagactgtcttgtaagtcacatcaatatagacaaagtatatcccagatatactgatatgcccccataaactagcgggtaaaaggacaccctcagtaagaaagaaaaaaaaaactgaagtacttaactttcaattttccattgaaaacatatgaaaagaagaatgagaaatacctgcaaactaagaacaaaaatctaatataccagaatttcttcaattcaaggatgactatacagggaacaactaaaaggtatgaggcccaaaaagcacaagtcgttggcaagaatatggaaaaaatggaagccttgtgcattgctggtgggaatgtaaaatggtgcagccactgtggaaaatataatgggcagttcctcaaaaaaacacagaattatcatatgatccagcaaattccacttctgggaatatacccaaaagaactgaaagcagggtctccaaaagagatgtatacacacccaggttaacagcagcactattcacaacagccaaaaggtggaaacaatgaaagtggccactgaccaataaatgcagaaacaaaatgtggtatgttgtatatacatgcaagaaaaggaggccggacgcgatggctcacgcctgtaatcccagcaggattgaacttgaacccaggaggcagaggttgcagtgagccaagatcacaccactgctctcaggccttggcgacagagcaagactctgtctcaaagaaaaaaagaaaagggtgttgagcattcaaaaggaattaaattctgatacatgctacaacatgggtgaacctttaaaacataaaataaaataagccaaatacaaaagtaaaataagccagatacaaaaagacaaatatagattccacttatatgaggtaccaggagctggggataggcagaatgaggggttattgtttaatgggtacagagattccatttgagatgatgaaaaagttgcatagataatgataatggttgtacaacaatgtcactgcagaagtaaaaggaagacaaaatgatctacataagcaaaacaaggcaaaaacttttgagagtagaccaagcataactatactataaaaagtttaaattttcctataaatgaaacaatttcatattgaagtaaaaaacaaaaattaaaaatttatatataaatccttaactgtcatgggattataagtaaaaaaagaaaataaaattctaaaaaaactttgtgaataaaaggttaaaagttcaatgagtagtagaattaaaacaaaaattctaagcaatatgaatagtgaataatttagggcaaaataaattagagtaattttctactgatgacatgtttaacaataaagactcaataaaaatgagtctgtgatctgaataaaacaggacatcaacaaaacatgttattgatatggacttataaattttaactcagtctttttgaacataattaaaattaatagacataaactttgaacactgcaaagaatataacttctccttaagtttccaagaaacactgacaaaaattaactttaaacatactttaccacaaagaaaacttcagtgtatatttaaggctatatttctctgatccccaagaaataaaactaaaaagcaataaatatttaaaccgaaagtagaacaatccttacaaaattaaaacagaaaaagtaaaacgccctcatacaaacaactactggtctagagaaaacaaattggaaatacagtgacagtcttattatattgacaggcaattaattcctccatacagtatttctccatgaaaacagtactaggaacaacatctctattattcaagtctatttacttgtgaaattgtttaaaataatcttgctaattctaatgatgaattgagtacttctcaaaatatcataaaaagaaaatactttaggaatgagttttacagttctatttccaacatttcttctaagcataaaaaaaatggctttttgtattgttttgttttgttttgtaggaaaggattgaaaaacaatagtaactggcccacattttttaattctttgggctaaagatgtttaagcaacaaccctaaaggagttgacggtgggggaaaagacccgtcctcacaggatactcatagtttttacaacagaaggtacaaaattgaaataccaggttagcaaaatgtcttaaatattaccaataaaacagattttatagtgtaaacacaacttacacactacctctgcaatatacaatgggttgtggattctacaaggcacctggagtaagaaactgcagcaggctctgcccctcacatgcttccaatggaccttccacactgcagccagtcacggttcctcctgccagtctcacaaggcacttctctgattaaaagcaatctcatcatgccttcagaggaaaggcaggactactcagcatcatgccaaaagacccctaccagcagaccctcatttatcccaccagtctctctccactatttgcacctcacatttcatggtctaggtgcttgtgttccatctactaccaggcctatcctttatctccgatcagaactatccatgcctctttgtcatggctcatggttcattctcacgctccgccagattaaaaaaaaaaaatgctattttatttgcttggccaaatcctacctataatttaaaactcagttcattcagatctacaaaaagccctcactgaggccgggcacggtggctcatgcctctaatcccagcactttgggaggccaaggcaggaggatcacttgagcccaggagtttgagaccagcttggccaacatggcaaaacccagtctctgctaaaaatacaaaaattagccaggagtggtgccttgagcccaggagtttgagaccagcctggccaatctggcaaaacccagtctctgctaaaaatacaaaaattagccaggagtggtggtacatgcctgtaatcccagctacttgggaggctgaggcacgaaaattgcttcaatccaggaggcggaggttgcagtgagtcaagatcacgccactgccctccagcctggacaacagagtgagactctgagtctggggaagagaaaaaaaaaaaaaaaaagccctcactgacatcccaagttcatagttcatagtgttttcaaagcaccattggcaataaaacataatggctataaatacaaaaccacaagtgaccctgaaaaataaactgtgcctcagttatggagtttgcagggtcatgataattaaatgacctcataaatagtgcttagtgtctgacatacagtaagtgctatatttaaactatcttagtttacgtgttattcctttatgcttatctctattttactaatgtcatattaaaagtatctatcacccataggcataaaaagcactacatcttatttgatatcccaagtgcctagcatatattaataacgggcaatcaagaaatgtgagttaaaataactgtctttggaatggtggcagcagcagggaaggtctatgtaattagagatcccactacaccagttatcaattcacaatctggtccaaatatccttaatgagcccttactggatacaaagatctttagtttctttcacaatcctcttagcccctcttgaagtcctaccaacattctacaattctaccaacatgccttgatgttgaagttaccagttcacagcaggtcagatgggaatttagaagcaatgagtcataaagatgaaaagactgctttccaatgactgcaatgacaggaatgacacagaagaaatgcggaaaagaaacagaatatagacctaagagtctaggttatctggcaggaggtgaaagctactttctccttgcatcttgaacctgacttagcatgtaaatagggaaaaaatagacctgatttgatgatggaggactagggggaatgacatatgacatactttaggtcagcataactaattttggtgaaaatattttttcttttatttacttcgagtaatataaaaatattcaattaaggggggaaattgaaattcccttccatgctgagttacagggttccagacatgattgatgttactgatattagtactgtgtggaaatacctagagatttgattatatatcctcaggtacttaatttctaaattgatagcaacatttattattttgttcctttaatgactcaacaaaaatactgcttccgtctttcttttgaaaactggcaaaagtatgaacattaagaaattttacttgtttgcttcttttaaaatatagccaaagaaaagagacatttattctttttaaacaagtaaaagtaaatcaaatataatttgaagtacttctgttttatttagcatttgtaacataccaactggcacttgtacaacagaattaacctttaaagtaaaaataattcattgaatcataaagtaccagcagccaaaagttaaaagtgaatgactaacttttacagataaatgttctggccaagaaaatttaagttaatttaagaaacaactgataaagcattcctcacacttcaaaggaaaaatttacttgttgaaaatcttcaatatgtgaaaaatctcctaaaagtactacaaaatagtgtgataaccttaaggactaaagaaaaaccaagattcagaactattatcagaaaatgaaagacttgaaaatacacccattttaaaatatgcagtttgtttctctttttaagaggctcgtgttatgaaaaaaataaaagtttgggtttctttcttacatgggtattgttattatgtaaatatctgtaatttatttttttatattcagacctctattcacaaggatttcagacagcctgtaacaatgtttaattaaatatagaccgacttacatcaaaatagcataaagagaaaaaaaactgataaacgtaagagtcaatatatatttttatgactaataaattttgattctactgccctgacaaggcagcaaaagggaagggaggaagggagaggggaaggaagaaagggagaggaaggaagaccagacattaggaattcacattaacagaagagatagaatgccaaatcttcaaggaaggcaaggttatcagatgacaatttcaaaatgaaagatattaaatgacaaatgatttatgatattttgaaatgttaaaaaagatatgttttccagttacatggagacatactctggtattccatagatctcttaaatattatgttgtaatataacattcttaaggctactactgtacacatgttgattactcatgcaaaatattacttatcaaaacacttcttacaaaaaaaacaaaatttaattccatattttctaaaattatctactctactgaaatacaaacagcaaaaaacaaggtatcctgaactctccacactttgaatgattattctaaagttgatccagaattttcactctagataaatgtacatttaagctcctaataactcacagataggccagttgcttaaatgacataattaaaaactttacgtaaaacttccaattctggccatgaaataataacaaggacatctcctgtccttccccagaaatcaactagaaagtggcatagtgtcattgcaggactgtgatgccagagagaaggaaaataagcaatgagagtcctactatacctgaaaacaattactgtacagcaaacacaggcaagagaaatccaaagagtctgacagtctcgatgactttaggagatgaagatgcctgtggaagctgacatggttaggaattgtgggagagctatgcaaagaaagaatttcagagacctaaacaagtttccacccagaccatgctgagattaggtggcttagattataggtagatactctgtaaatacaggccaaagatgattactgagatttaaattgaacaactcccagggctcacacaagacaataaaactcagtcttcaaccaggcagagtagacagtcatcaatcatcactttggacattcaatagaggtcccaaaggatcacatctcaggagcagagtttaaccccaagcaaaggttcttctagatcagggtttctcaaccttaacacttcctcaaggttttctgacatcttgagctaaaacattctttgttgtggtgagctgttctggcttctatctactagaagccagcagcaccactccaggtgtgacaatcaaaaatggctcccgacgttgccaaacatcctctgggaagcaaaattaccccccagttgaaaaccactattttagacccattctagcaaaattttttaaagtcttgagaaaatgaaactgctctacaagtaacataaccacctgtcagcctcaaacttctgggttcgagtgatcctcctgcctcagctttccaaatagctgggactataggtatgcacctacatgcccagctaatgttactaatttttgaagagacaagatcttactttgttgcccaggttcatctcaagctcctggcttcaagtaatgctcccatgctggcctcccaaagtgcttcagaaccctcccaaagtgcttctaaaagggtaaaataaaaaatcaagacactcaacatggtaacattgaaaaggtccagcatccaatcagaaattactacacatatcaaatattaagatccataaagagaaaagtcagccagtggacaagacccaaaactgaaatactcaaatgtataagacctatacactgacaacttcaaaacaatgcagagacaaattaaagagctaaataaggctgggcacagtggctcatgcctgtagtcccagcactctgggaggccgaggcaggcagatcacctgaggtcaggagttcgagaccagcctggccaacatggtgaaaccctgtctctactaaaaatacaaaaaaattagctgggcacatgcctgtaatctcagctacttgggaggctgaagctgtagtgacagtcacttgaacccgggaggcggacagtgcagtgagccaagatcatgccactgcactccagtctgggtgacagaatgagattccatgttaaaaaaaataaaaataaaaataaataatgagctaaacaagtgaagacatatatatggtattcatggatcagaagattcaatactattaagatgtcaatttttcctgaattgatctacaaattcaactcaattccattcaaaaccacagcaggttttttttttttttgtgtgtgtgtgtgtgtgtgtgtgtgtgtgtgtgtgtgtgtggtggcgggcgcctgtagtcccagctacttgggaggctgaggcaggagaatggcgtgaacctgggaggtggagcttacagtgatccgagatggcgccactgcactccagcctgggcaacagagcgaggactacatatcagaaaaaaaaaacaagaacaaagttgaaggacttatactaccttatttcaagacttacaataagcttcactatagctaactataagccttcactataagctacaataattaagtcagttgggtattggcatcataagagaaaaccgatcaaatagattccagaagtaaacccacatatagttagttggtaaggaattcaggaaagaaaggacagtcatttgaacaaatagtgctgagaaaataattgtatacccataaaaaaaaaagttcattccttaccttgtgctagatacaaaaatcaactcaaaattaatcaaagatataaaacctaaaacatatgtaataattctaaaagaaagcataggaaacactctttgtattccaagttaggcaaagatttcttagataaaatatcaaaagcatgatccataaaagaaaaactaagaaactgaacctcatcaaaattaagtttttctgctcttcaaaaagctaaatgatcatctcaatagagacaaaagatttggcaaaatacaataatcattcatgatcaaaactttcaacaaactaagaatacatggaacttcctcaactttataaaggcatctacaaaatacaaatgtactagagctaatcttgtatttaatggtgaaagatcgaatgcttccctctaaatcatgaagaaggctctcaccacatccatccaacattatactaaggcttctagccagggcaattaggcaatttaaaaaaattaaaggtatccagagtgaatagaaagaaataaaactgtctttattcacagataagatgatcttaaaactgtttttattcacagataacaagattttatagatagaaaatcctaagggatctaccagaaaacaaaacaaaacaaaaaaaactaccagaactagtaagttcagcaaggccaccaaatagacgatcaatacacaaaaatcaattgtatttctatatactaacaatgagcaatccaaaaacttttaaaattttcattcacaatggcattgaaaagaatacttaagaataagtgtttttttaaaaaaaaacctagacttgctctctaaaaattacaaaagatgctcataatcatcagtcactagggaaatgcaaattaaaacccactaagataccattgcacatctatcagaatgccctctcccccccaaaaaaaaaaaaaaaactgaacataatagatgttgaagatgtggaacaactggaatgtccataggaatgttatttgtaataactagaaacaaccccattgtccaccaacaggtgaatggataaacaaattgtggtatgtccacacaatgtaatactactcagaaataaaatgaataaactacagtaagccttcacttaacttggtcaacaggttcttggaaactgactttaatgaaacagcattacaagttccatgccatttcactaaatgctgatgagaaaaaataactgggtttgttataagtcagtttgcttaaagtcacagtttccgaaaacctatctatgatgccaagtgaggaactgctgtactactacataaacaacatggctcagccgggcgcggtggctcgcacctgtaattctagcactttcggagaccaaggcaggcagatcacttgaggccattctaccataaagacacatacatgtgtatgttcactgctgcactattcacaatagcaaagacatggaatcaacctaaatgcctatcaatgggagactgattaaggaaaatgtggtacatacacaccaatgaatactatgcagccataaaaatgcatgagatcatatcctttgcggcaacatggatggagctggaggccattatcctatgcaaactaatccagaaacagaaaaccaaatacacatattctcacttataagtgggagctaaacaatgagaacacatggacccaaagaggggaataacagacaccagggattactcgacggcagagagtgggaggaggaccacaaaaattacctatcgggtactaggcttattacctgggtgacaaaataatctgtacaccaaacccccatgacacagtttacctacataacaaacctgcacacgtaccgctgaagctaaataaaagttttttagaaaaacagcatgcccacttaaataaatctaccctagagacatacctgcacatttatgaaatagcataagcccattattctttgtacataatttatattaacaataatatccatcaagagactaggttaacaaatacacaacgaagcatttgctacctataaaaaagaacgagaaaatctcacgtatagatagatagggaataatcctcatacctactattctatgcacataagacgtatttttaagttataaaaacagggtgcaaaacagtgtctataatataccaccttttatgcaggatggggagaggataagaatctacatacttagttgcttacatttgcaaaaataaaataaaaatagaaaaaaatagccagaaaataaaaatgactaccaataaggaaaacatcttaaaggtaactggatgggagagaggcatctctgagctacatttttatgaagaaaaaacaattcccaatagtgaaaacaaacaaaaaaaaatctaactgtatgctgaatgggtaacggtagctttaaggcacagtattttgactgtatatccttagtgagattagtctatctcaaaaagaactgccaggaaatcttgaacttttcattagaattgttcatagcaatgttaatattgctgttctgaaactatcttatgtatgtttaaggtcaaagctaataagcaattatgctgatattgctaggaacgaagactttctacaagcgcaaggataagaaatacaaatttaaaataagaaaaatagcaataaactcacgatctttaaaaatacgtatttcctaattgttcctgaaagaaaagaatgatatcacagtagctataaccacctctaatggcctggttttggtcttaatatacgttccactattagaagtaaccagaacctttggaaaaataggcctgttccaggctatttataacataagcctgggacatattgagtcaaaaagaaaaaagattttgaacacgaatgagacaatgaaaccggcttaaaagaaccaaaatcttaaaaaatactattccctatatcccaaagaaaacattgattcttaccatatctataccaaaaaggctgctgtcatcccagatatctgttgaaattgcttcaccaataagtgtcatatcctctgtaagcaattccagaactcttattatcacttgtctgctacctaggaatacaaacagaaaaaagtaaaggagaagaagttacttaactttaaaataatcagctgaatatcatattgctcaattttctagttagtcatgctccaacattttctctttttttctaatgttcttagaactgtagagaaatcacaatttacaatcacactgaaggcttctgttccagtcacagtactactttactacataacaaatcaaatacatttataattggaaaagatattgaaagtagcaataatctaacaagtactgtgagatagattaaaataatttttcgaatttagggaccatccattttacacgtaatatgtgacaaagcaccagaaaggtttagaaaacgtattccaataatttctacttagtactagaaggcgtgagccttctcataaattagtattttcccacacaggagttgcctgggaagctaagcttggactggagcaactaaaggaataaatgaacatgctaacatttgctaaagaaactatttgtactcaccttaaactcaaaaaaacttcccaaagtcacacccaccagagcaacctcctttctccacagagacagaataacaaagactccacttccattatcctgtgtgagacgaacattcacacgagactttcccaccccgcatcccaaaggttaagttctaatgaatcaaagtaaaacaaactaccagattggaaggatctagattaattttttcactagaagagctggaccaaattctcttacaaatctcttacgatattgaacagttacaaatcatgccataatttaccacaaaagggcaggagaacatttagtttttatgtaccaagatatagctttataattatcaatctgactttttaaagcaaattaaggaaaggttaaatgcaaaatcattaaagtctaagactgttcttctcagcttaccagacagataaacatatgtactttatgatgccaaagttcagatctttcttcatttcacattattagtatatgaattaatatatagttccagctagtagaagcacttactgagtaaaaagtatgagtacacagttttcctcaggataaaaacattttaaatgttttccaaatatataccttcctgcttctttctcctccatcacctccaagtggcaaaaaatagacatgggacttaaagaaccattaacttggaatatatatttttactttgccagtataaagtaaaaagggcaaaacttggttatcttatttatatcctgatgagtttatcaaacgttgaaaatgtatagattttgagaataaaaatcatgactgttttctttctaaaactttctttacaccttgcaaaatgctaaagtatttaaaagcatggactttagattcaaaagaatcgtggttcaagtccctgcttttagccgtttgacttcaggcaagtttctaaaccactcaaaaactcagcttcatcatttgtaaaaatggagataaaattagttaactaccagtgaaaaaacaaaatgggttgatatgaaaaatacacgaaataatgcacacaaaaccaagtatgaaggcagaacccagtagggacacgtgctaactgttgtttcattactagactcagcagacctctgtcatattgttattgctgttaccattgttcagtacaattacaattaaataccagtgtatatttcagtcaacctcttcaaattttcctagtacatctgaacaaaaatgggatctcaaaatatttgtggcttttttaagaaaaattactacaaaggtaagaatccagttttggagttttgtttttaacatgttaagtggcttaagtagcaagaaatgaatgggaagagtaaacaactgacagctaatcaaaaagtttccaaagagcaaaagccaaagatttttttattctggtctattcatgccagtccaccttttataccttattccagttgctgaatgttgtcactgctcaaatttaaaatagccatacagtccaaaaaaaaaagaaaaaaatagatgacagcaagaataaatgcaaaaaatagataaaaattctaaaaaaaaaataagcatgaaagcctgtgccaataaaaactcataaaatggaagggcaagctgaatagccctccaaggcatccacatttaatttaaaaataataaagaccttattaggtttttagaaatttatatcccaaaagataagtaaatacagattccaaaggccctaacatagaagagaaaaaaaggaaaatcctaacgaaatacaaaacagacacaaattatatcagaattacgatttctaaaacaactaacctgttcttaagagaggaacagctgattccagaatggagacacaaaactggggaagactgagctgctggaattgtagttccaatgtgtcttcagtttccagctctggcagatctatgtgtcccatatccaaaggtgaatgaacggatatcctggagtttacatgagcatgactactacttccactgcaagataaacaaatgataaaccttgcatacagaaacaatccccaaacagatttactgcatatctgctgcctcgcatattagaagcctcatacaagtcacaactctactgcttcattcaactctggtcagatttgtagaaactttgacaaatttacgaaattaaattccataaagatgactcaaggccaggagtggtggctcatgcctgtcatcccagcactttgggaggccaaggcgggcagatcacctgaggtcaggagttcaagaccagcctggccaacatggtgaaatcccacctctactaaaaatacaaaaaaaaaaattcgctgggcatggtggcacacacctgtaatcccagctactggggaggctgaggcgggagaatcttctgagcccaggaggtagacgttgcagtgagctgagatagcgacactgcactccagcctgggcgacagagcaagactccatctcaaaaaaaaaaaaagactctaaattgtaaatgaagccaaaaatgcatctatattttgcttgtcaggctgatatctcaaaacatgtcaacattcctatagtaggaatcaatattagcactgataacccattcatttccaaaaggaaataagcagatttataggaaagctcttctgtaatcaacgtgtagagacaaaaccaatagttcataccgtttcctagattttctgagtttcaccactgttctgagtaagccagtgttagtaaatgaaggatgtttctagaaaaacctcatgggaaatgtattacttcacttagtacattcgacatcatgtagtgacttcaaaaatgcacccaaaaaaacggaacatcccattgtccttggctttcttcattaaaaagttcttacctcggatgtaaagtgctggagtaaggatttaaaaagtgtagaaaggctagagcctcacacttacaaagagcctcaaaattttgtcttttgatgttatccacaaccgaagctggatcacaagagacatattaatgctatggaacatttaaatttgcccaaattataaaccaactttgtcgtttcttcaatttcaagataccaagcaccccaaaatatggaaacaactcgggcttctctgtaactctgaaaggaagtttcagtgaggaagctgttcactcaggagtgaaaacttagaagcatgaagcacacaagagaatgaggcagaaaggcttcaggagaaagagaaaaacatggctgaacaaccaactacaatataaggactaagagcatagactctcctatcattttatttaaccctagctctgctctttaccaactgttatgctcttaacctctctaaacctcaatgaggatgataataataatactaatgctatatataatatcaatcctattctaggacaactaaaggagacaaagtatgcaaagcacagggcataacaccatacacacagcaggtatgaatcagtattagcttgttaacagtagtagcagtattgcaagaaaataattaagccaacagaccaatgcttaacttagtgaacattttttagaatgacactaaagagactaatatgtttctaacacatttgcacccaaggataaggtaacatacaaataccacaccaatccttttaagcagagttggtgtatgaaaatctgggtgccaagcactgggggccaagcatggtgactcatgtctgtaatctcagcactttacgaggccaagatgggaagatcacttgagcccaggagttcgagaccagcctgggaaacatagtgagaccccatctctacaaaaaataaaaggcttagccaagtatggtagtgcacatctgtggtcccagccactcaggaggctgaggcgaaaggatcacttgagcccagaagtcaaggctataatcgtgccactgcactccagcctaggcaagagagtgagaccttgtctcaaaaaaaaaaaaaaaaaaaagaaaaaaatctgtatttacacaaacaaataccataaattgttcaccttgaaggagtccttattttataaaattctccaaccattccttttaacagtaaacacttatccatttgttataagacttacaaaaatatgtgtaaaatactatcaacaatgtatctatcatttaaagctattcttttaaacttgatcatattccgtttgcagctggtaaaaacaatttattgggtcagaatcatttcttttctaatgaaatcggaactgaaaatatagttcagtgtgtcaaacatagtatcagaatactattatgtgaacattttgttttgggggacacatacacacacatatatatacataaacagagcatatgttcaagtactgagcactgagttgcgatgtaatatttatctgtccttaccgtggatcatggtcaaaaaaagtatgaagccagggtttaacacaaggcctatacctgtgttaatgtttcaaaaaaaaaaaaaaaaaaaaggacagaaaaataattatctccttctgaaattaacacacacacaagttaaccggcatttctcatttccccagagacactgctagcagtcacctagaggacgctgcatcccagtcctggccatctcctctgggtcgctggcctgtgcgcccaaccacagaaggccgagggctgctgcttcctggggaaggattctgggaatgatgagtacctcttgcttcatgacaataagacaaagaagaattttgggaaactgtgtctggggaaacaaagaaaaaataaaattattctttagtagaaacagacttctgactatgtggtatttatgtatcattcttccaaaaacattaacaaattaagatagtaggaatccttctacaggggtaaaaacaaaagcaaagatcaaacttttctataagtattcacttagtacatttaggtttatatctaactgacttgattacatgggaccttctagtcaatggcattcagttacaacattagagactaccaaagcagaaaaacactagatcatgcactcgtctgcttaaaactctccaagaatggctacctcatactgtacataaaaattaattcaaagtggatcaacaacctaaatataaaagctaaagccataaagctcttagcggaaaaaataaatcttcatgaccttgaatttggcaatcgattgttaactatgacatcgaaagcacaaacaaccaaggaacagacagataagctggacttcatcaaaatctaaaactttggtacaccaagggaacattacaagaaagtgttaagataacttatagagtgggaggaaatattggcaaaccatatatctgataagggtttaattttcagaatatataagtaacctaaaacccagcaataaagaaaccagtccaatttttaaaatgggcaaagaactttaataaacatttctccaaagaagatacatgaacaaacaataagcacataaaaagttattagagattcattggtcattaattattaggtctttagagaaatgcaaatcaaaaccatgagataccacttcacatctactaggatgactacgattatttttaaaaaagaaaaaaatgaacaagtcagtgatgatgtggaaaaactggaagctttatatattgctgatagaaatgtaaatggtacagctgctgtggaaaatagtttggtgattcttcaaaaagctaaagatagaatttccatatgacgcagcaatttcactattattcactgggtattacccaaaagaattgaaaccaggcactgcacagatacttgcatgccaatgttcactgaagcattattcacaaccgccaaatgtgggtacaacccacatgtccatcgacaaatgcatagatgaataaaatgtgggatatacatgcaaaggaatattattcagccatataaaggaatgaagttctgatacaagctacaatgtggatgaagcttgaaaacattacaaataaaccagacacaaaaggacaaatactgtatgattcctcttagatgaggtacctagaatagacaaaatcagagacagaaagtaaattagagtttaccagctttggggaaaggaaaaatgaggaatcactgcttaatgattagagtttctgtttcagataatgaagaggtttagaaacagatagtggtgatggctgcacaacaatgtgaatgttattaatgtcactatattgtatacttaaaaatgtttataatggcatattttatattatacctattttaccccaatttaaaaaaagaattaggtaataaaagcatttacagtcagagagagggggaaaaaaaactctccaagagcttctcactacacttcaaagaaaatataaaatctttaaaaagatctgcaagccccaatatactctggcccctaactacctctctgatgtcacctcattctcctcttctgcccagctcactgcagtccactctcatgggctttatttcagttgctcaaggacatcaccctcagtgctaaccttgaggcctggccttccctggaacactcttcttgcagctcttcgagtgacgattccttgtcacccttcaggtcacctcctctgagggactttctctgactatcctaaatgaagctatgtttacccaaccacgttgtgtcacatcaccctttttatttccttcaagtacttctccttatctcaagcaaacttgattgtttatcacctgtccccagccttttaaaatagaagctttctgagggactttccctgactatcctaaatgaagctatgtttacccaaccacattctgtcacatcaccctttttatttccttcaagtacttctccttatctcaagcaaacttgattgtttatcacctgtgcccagccttttaaaatagaagctcataagggcttggatcttattcgtttgttcagtgttatacttccctagaggctagaatatcaggggcataaaacaggtaataaatacatacttattaaatacattaacaattcttcagagatatcaactttttaaatcaacattgtaactctttttctgttgaagtatggggtacccagacgttctctattaccagtcatttgtacaatgccataccctctaagatctagaataaaaccaaggtaaagcataaatattcaagtagcacaggatcagtgaaactcccaatgaaatagggattaactatgaaacatgatgacaaatgactataatatttgactttcgatgcaggttgcattaagctcacaaaaatcctaaatggtactggttttgtcgaagccaggctggtactctatttggccattaggtggcactttttctctgaagtctcacattgctgcaacacttgactacattgcaagttgcataaaaatactcttcataaaattcaaatcaatatttttcaaacaaaacaatgtattaacactatatgtaacttgctaaattgtccaaagtcctacatgaatagccataccaaatatccgagtcactacatcccaacaacactatatagaatctctgcaagtttgggagaaaaaagaaaaacaccttgtaaatatctcttatccagaaaaaaaaaaaaaggctcaagagatcatggcagtttctgtcattcacgcaatctgtaaagataatcatttgaatacatttaggagtggggagtttatgttgtgaaaatgcgtacacaataaaccctaacagtaactataatggaaggttcccagaagaatctacaaataacaccagtggctaatgaacagataaaaataaataccgtgtttattggagaaaaaacctggatctcggtgaaagttaagtctgtttcttaaatacatgcacagctgctgcaggcaggacaccgactgtaatgccaggcgatgctttccatctccaaaggccagtttcaacagagataaaaggctctgaaatcaagaagagccgtgaaaattactaagggaacaaagagctcaacttcaaagcagaatgtggagcttaagtaagtaagcctaagtgaataatcaagagaaaataagttgccaaatatttgtaagacataagaaactgaaatgggcaaatatgacttggcataaagcaaggagatgggtcaaaataaaataagacaacaacatttaaatagaatagtcagtgtttcctatttctaaaatctgttagttgagtaaccattctgagagaagacagaaattattccccactcaggacattacattacagagaacattttaaaaatcacagcaagcccttttcatctcaagcatctaaaccatttaaccacattttagtaattaacagctttcctctgcgatcatttgccagctttgatcctaggtattaacagttggcacccactggagtccatttcagccctgggagtgtggagcgagaatgctgagccattactggctgctgtgaagatgttgcaattccccaccctggatccctctctctctactatacaagcaataaactagaaaaaaagaaaagaatccatctgcgttactcaccgctactgtattttcccagcatgtagcactgtgcgttaaataaacgagatactcaagaagcaatgctattcttacttttaataagggctcctgcacaatctcaatgtccaaagtctactctaccatttaggtgatccataaatggtaactcaaggtggccagactggactgcaagtgtcaaatgaaactactactattggaagaactataactatccacccaagttagcgaataagtgctttaaatagccaaatacttcactttttaaaaacatgagtacaaagttccttcccaagaactcctactctgcaaaatttgctttattgcaaaaagttctctagttcaaaatctaaaacaattatagagggcactgacctgaacaatttttggcctttgaaggaaaatctcagcaggaaaatcttgcatgataacatccttcaatagttcacaggtgttccagattaaagtgtggttactacttcttaaagagctacaaaacatagcgttaatcatttttaagaagagttcatctattccagattctaagtagcctactgacacaatgactccattaacaatcttttgggtctcagctgagatatcacttctccagaaaagccttcctagatcttttccctaaccaataaacaactctagggcagtgctccttccgtttgtccattatttgtgatattgttaactgcctgttgattttgcattccccactagaccctctcaagagcaggaacgacatcatactaaacactgtaccctcagagattatcacaagtctgcaaaacgagttcaatgaggtcaaagagcacacaattctaggaaatctgccaaataaattaagaaatgagacagaacaaaagtacagaggcaaattctaagaattaaagtccttactgatcttccccactcaaggtgaatcagattaggactcccctcttatcccatacagaggacacctatcaacttctgcccacctaggattggcagttgttcactccccaccccaaaaaaatcacaccccttctctcagcccagttccattatactatccaccattcactatctacaggcatgcattagaaattatcgccatctctgcctttgggactgactcaaaactgagagatcatacaacctcctaaccctttcccatgtgcactttgcctctcgaatatgttgttccaagagaattcatgtcattattaaaaatcacttaatggcatccacctgtaatctggacttagccctagtaaattggtctttattttccagatttataccccaaaaaagcagataactcgtgtattgtggcatttatgaaactgcacaaagtgaatctggacattaaaatactctctaaatctctatatatcagctatttactcttgtgggtagcaatcaattaacagtcattacattagattggatcagtggtacccaaccttatccacatggtttaatttgtctcctaatgaagcccacattttgaaatatattctgccaaaaagactacatttatgttcaattttccatttttatcaatcaagggcataagcaatggccaataagagaatctggccaataagagaaaactcctgtcaccaaggactacacaagagtccaaccacaaaaagaaacgtgggccaaatgcagtggctcacacctggaatctcagcactttgagaggccaagaggggcggatcacttgagattaagagttgaagaccagcttggccaacgtggggaaaccccatctctactaaaaatacaaaaattagctcagcgtggtggtgcgtgcctgtaattccagctactcaggaggctgtggcacaagaatcgcttgaacccaggaggcggaggttgcattgagccagatggtgccattgcactccagcccgggtgacagagtgagactctgtctcaaaaataaataaataaataaataaaagaaacttgatgtgtagattgattaaaagcaaataggaatttttttctggctagctttttgaaaaataaaaatcatttaaatatgaccattactacctttcactgccactagtatcttttcctggtaaaacatattgtaataactatcaaacttaatgactataagtgaacaaaaatacctgaaaatacatcaagcaccgtacctttcattagaggagaggacatgtctgtctgtggtggtcaggggtagccaaggaaatgtagaaaacttcaagcacttcacagtctgatttactgtcagtgaaagagcaaatcttatggtatcaaagaataaagagatgacagattcacaatgttaagagtaagttttccctttaaaacaagtcccaaaataaaggctgcatcttacagtaacctaaaatataccaaacaaggtcagctgcaaatttgttctatcacaggataaataagagagttctcttttcataatttaaacagaactcatatgatatcaaaataagtattagaagaagagcattaaacacaatccaatacagactgacatatgaagtttccattaaattttctattttaccctgtggctgaccagaacatcaaacttaaattcaacataaaaggaactgacatttagggaaaaccttaacttttcaaaattaaaaatgataaaacataatgatataccatatctagccatgttcaaatatcctatatggtgtcaggtgttttaaacctctgcgaagatgacttgaagaccgtaaggtcaaaaaacaagtatcagtgttcgaacaagattaaaagaaatctgagaaagcaacagttttaaactatccccatgcaagttatttttaacagatcttatatagtacaagttaaggtggcaacactgagaaatagcatctacataagtccttccaaatggcagtctttctgccaagtgctttgaaaagagcatggaatcgctaaatgtggatagcagtattattaaattcccaaacatagcacagttacttctttcaaaattgctaacataaaagcaggatttactttctaaggaaataaggagaggtgggtggagggaaggacaggcttacaccacacagtaaaaatgtgtccaaaataagccagaccctcaatcaagacaaactgcaactcacataaaagtgtaacaatctcaatcccccttaatgttttcatcggcttcattcagacacccatcctttaccaaccctagagattccccctcccttcagatgtctctcatcttgatggaattaagcctctcagccatctggcctcaaaaacaaagcttgctacaagcctaacaatgaatgaaaaggtaaagtattctaatggcttaacaagttttcagttctttcttgttattccacctgtgagtttccatgaaagctttttaataacagaggcttccaaatggagttcatttgaatatgtgacatcagcagatatactcttgaacatatccttttcaacttaactgtgcaggcaagaaaatggtaagtacgtgattacttaactacttcctaactgcctcaccaaggacaaagttttcaacctttctaatctcagtgtctttattagtaaaatgtggtcactaataataccaatctcaaagacactccaggaggattcattcattccttcaaagaatatatactgagtgcctaatacattttttggtattgttccagacactgaaaataatgcaatgttcacggctattatcaaacttaaaacaaaaataataaaaaataatgtgttaggaagaaaactacacataggaagtgatcactggctagaatcaccaggaaggtctctgatgaggtggcatgtgagctgaggctgaacacagccagatacaaaaagatggagatgagattccagattccagaaacagggttctaaatcagaactttttaattaactgggtggtgaggaaatgggaaaagaaactaaaatgatcttcagcctctggctggcgtaactggatagatggtgccatcgttaagctggagaacaaatgagatgacatgtgtagtgcagggcacaatgcctcaaaaaactcatgttcggccgggcgcggtggctcacgcctgtaatcccagcactttgggaggccgaggcgggcggatcacgaggtcaggagatcgagaccatcccggctaaaaaaaaaacggtgaaaccccgtctctactaaaaatacaaaaaattagctgggcgtagtggcgggcgcctgtagtcccagctacttgggaggctgaggcaggagaatggcgtgaacccgggaggcggagcttgcagtgagccgagatcccaccactgcactccagcctgggcgacagagcgagactccatctcaaaaaaaaaaaaaaaaaaaaaaaaaaactcatgttcattcagtacgacatactactgccattaataccatccatctacacagttgttcaaatatggttagaataacacaaaattttatcatttctactcgatatcctaaactaacttgaaacaactaaaacatttaatgatagtttggtgctgaaacattcaagtttggtaaaaatacatcttcacaataacgaaaaaagtacattaattttcaacttcccaagtcaacaggatttacttcccgacatatacacacccactggtcgtggcggcacttccatctgctggaaattacttttgtcttggggaaaatatcctgttaagatttcagggttttttgacaattctgaaaaggaaataaacattactgtattgtcgattccttatttgctaaaagtgaaacttactttctttaagtggtaatgttttctcttaagtattggaatcattttaaaaattaaaaaaaagtccagttttttttctgaatgatctatcttgctaaagaggaaaaaatgtgcacattgagcccacttccagttaagaagctttttccctctcacttttactgttagccaaacacagttatttgttagaatgtacacgaagaatctgctacaaagtattcaaggactatccctctctacttcctaatccatctccctctcccttgactccaattatatagttcctgatcacttcaattttcattcataccttaaaaagaaagttgtcaaaaacaaaggagtcaaatattatctttcaatacctttacaattccctataacatgcgattatatgttcagcagttcagctgcaatgaaaatgaggaaaaggctaaaactatagtttgtaattttaagttttcatggcaatagttcctaacactaataaagaaaaataacatttagccctaaaccattcctctactttcacccgcaaggaatcagattaaaaattcacagtgtaagactctactttatttgtgatgtcttcgaaactgtaaaatatattgttaaaaatcacaggtttgggagccagataaagcaatgttagaatcctgcatctgctacaggttagaaaacttggtactgtggggcaagttactttatacttttattctcagctatagagtaagactaataacatctcagtcaaaaggctgctttaagatttaacaagatgatgtgtttaaatcaatgtattcaatgcccacaacaaaactcaataaatgacagctgctattgttgttgtgaaccgcagtacccacagctgaagctgtaacagtactggcagagaagaaaatatggtctaacaggttaagcatcaaaactttttttttttttttttacttttactactcagtcacataaattgcatgaagatgtttttcttcaaatcaattcaaatgcattccatgtgcaaggcactatactaggcattaacaacaacacaacagcagcagcacagcagccaacacagccacatttcatacatgctgggccctgtgctaagcactttacagacattgtctcatctaatctcatgacgattctatgagaaagtgttcttttttttttttcgagatggagtcttgctctgtcacccaggctggagtgcaatggagtgatctcagctcaccgttgcaacctccgccccccgggttcaagtgattctcctgcctcagcctccctactagctgggattacaggcgcccgccactatgtccggctaatttttgtattgtatttttagtagtgacggggcaccatgttggtcaggctggtcttgaacttctgaccacctgcctcggcttcccaaagtgccgggattacaggcgtgagccaccatgcccagcccggtgttctttcttattatcccagtttttgaatgagaaaactgaagcctggaagggttaattaccttagccaaggtcacacaactagcagcagaactgagacttaaatccatgtctctttgacttggattttaacaagtatatcatgatggactgcagcatataaaaatacttgcattatgtcgttttgattggtccccacaacaagatcatgagctaggacagatatcattatactccaatatgacgaacaaggtcaaaaatacaaatataaagcactaagaacaatgagcactcatgtgctcaataaaaatacattgttattgccaaaaaaataatctgtcaaactggcctcataaaagcaaagtcactggcatcgtttaggcctgacccaaaaagcaattaatgcaaatgtaccatcctttgactaacagtagaggaggggaaaaaggtcaaaatcatgtaagttaacacaagaaaaataagtttgggggaggtgggagaaatcctttttaaaaaaatctaatctccctttccttaaaatttaccattagaattaatatatttgtatttaacagattccaaagagttaccagtttgattggtttggtatgaggcagaagatagtgcaggaacttccgaaggaagaagaaaaagtccatccagaatgccatcaatttcagcctgcagatttggctccacattagaccgaagcttagataagaactctactgcaccaacgtcaaccaaatgttggactgctgggggatactaaaataagaagaggatgatcttgagaataactgtatcaaaatctctataacttacagcaatcaaaacataaaattatttttggtatatcagatgttccttttctgaaaaacaaatccttcatggctctgccccgaagtaaggcacttccatgaggagcacatacacctatagagacatacatccaacacttgataacatttatgaaagatgagccaacacactgaacgctagaaatgcacattatcaatccctactcttatttttttaatgggttacttttttccactgacactcaccttatggtcccagccccaaccggtcaacaggatgtcaaagtagtttaagattcctctaccattgtacagtgatttagttttgaaaggttaaacttacactttgatatctgaccccgataactaactactcttgaggtaggcataagaataccaatctaaaagcatatgggcaagcaacttaacattggtatttatgaatcacggttatgtaacattatttttaaagtgctccctttcatactgacatatctagtttttaagatgtaaatgtcagaaaacaaaaacagaatacaaatattaacctccaaagataactcaaaaacacagaacataccaaaactcaaaagaagttctgtgttacttctgagcacagcagagaccatgtgggattcagtatcacaaataaaagatgaaccatatacccagattaattaaaattaaacatctctggttgattaaaaaaacttttaaccccaattatttaactttcaataaacgctacaattaaatgactaagaaacaagtcactcgtctgattattttctttatttcaaaatgaccctaccttaaccaatctgcttaacaggttcagaacctcttccttcatcggaacggacgggaaattgaaccattccagcaaatgaagaaaaagttgcctctcctgaatgagatcagcgtagcagattaagttgtgctcaatcttgcagagaatactcttgagagcgcgctccctgatctcggccagctgatgacctgtcaacgaacggcacaaaactattttatttcccgactgcaaagagactacgttatttatgctgtgggcaggagcggcgtgaagacggaataaaccagtttttttcagaagcaggccactggtgccttcgggacgcgaaccgcgaagtttacacaaagtccgagatgggtccccgggggctatcctgacaaagcgggggtgaaagagggagcggtcgcggagcggccggccgcggaaacgtgacacgaccattctcagcaagtggccagagcgcggggggtgccttgggcgaggggcaagctgacagttaccgagtttcctgatgagccctgccaggaccatctcgtcccgtcaatctgcagccgccggagaattaaactgccgcgccactgcgtccagccacaattaat

SEQ ID NO: 1319 - DNA, 127226 bp, Homo sapiens
ctttagaagtaaatgtattttttattaaatcagaaaaagaaagatacagtttacatgactgtcagtcaatcatatgctactttgaattacattttaatagactcagggtcctatttactcctttgtacaggtattaaaaacaactcaggtatttgagaagtcttctgtaaatttttattaactgaggttatggggagggttttatcagagcacatcctgagaacattaggaatgacagacacacttgagataagtgtcagacggaacagatgaagcgagcccctcagccatctgagaaacattaataatgtaagatagcagagaccaaatctttgttagggatacagtattacaggataaaaatggggaccttgccgcccccttgtgttgcaaaataaccgtgcaacttcctttattttttatttattttttttttttaagttgtaatctttgccgttgtcactgagcctcaaaagcaattgttttcccaaatcattttaagccctccccagtcaatcttttccctctcatcaataacttacaaggaccctatttgaaaaacaacgcttattcattcctttttctataccccacacattccgttctaggaaattggcaaccacccaacacagcccgggttctccctccttgagatgtgaatttaaacaaatggattttcgtctcccttcttcaagcttagaggataagcacgcatttactacaacgcttaattccttctagcagcatttctcttctataacttacttgccactgcctttttttttttttgatagaatcttgctctgtcgcccagggtggagtgcaatggtgcaacttcggctcactgcaacctccacctcctgggtacaagcggttctcgtgcgttgggctcccgagtagctgggactacaggtgtgtgccaccatgcctggctaatttttgtatttttagtagagacggggtttcatgatgttggccaggctagtcttgaactcctgacctcaggtgatccacctgcctcggcctcccaaagtgctgagattacaggcgagagccaccacgcccggccaccactgccattttcatcacttaacccgaacacattcctctattccctccctttcctgcttggtgatcatcgactcttctgacccaactaggtgacctgctaaaccatctttactgttatttgccagaaaagactggaccagagacgtaaataatacacctcaatatacaacagctcgggcttaatttctaggcagaatttcatttgctggccatcagaagaatatatacatggagcgtgtttggggaggagatggagtaaggagaacacatcttggtggcaggagaacctggtgggaaccgtgctgatttgtttacttggatttgccaactggtccgatggatactgggtctgtttgcacttgagcatccaacatccgctttggtccctggagaaaaacagaaagacgtggcagcctattgaagctctgtaatgtcaacagcaacaatggccatttatgtagcacttactctgtgctaggtgttgggctaaattaatatatctcattcctcagtgctgggtaagagaatggtctccagtcagatgcccgggttcgatacccagttacatgactttctagctttgtgaaatcttggacaaattacttatcatctctttgcgctttggtttctttatctttaaaatggaaatgacaaacttatctcagagggttgttcccaagataaagtgagttcatgcttataatgtacttagtacctagggggtactaattctacctcactttagctccctccccagttaccatctaggttcaccaccctgttttattttcttcttttttttttattatacttttaagttctagggtacatgtgagcaatgtgcaggtttgttacatatgtatacatgtgccatgttggtgtgctgcacccattaactcgtcatgtaacattagatatatctcctaatgctatccttcccccaaccccccatcccaaaccctattttattctctctcagaacataccactctctgaaatgatcttattatctaatttatttgtctaacatctgtcttctacaccagattggaagctgcaaggattctgcgtgtctcagtgccttgcaggttcctagcacatggtacctagccttaacattgactgaatgtgggtgaaggaatgttgtcaggcagatacaattattttattttatttttttgagacaaagtcttactctgttgcctaggctgaagtacagtggtgggactatgttcactgtagccttgaagtcctgggctcaaatgatccccccacgtcagcctccccagtagcttggactacaggtgcacaccaccaaactcagctaattttaaaattttttttgtagagacggggtctcaatttgttgtccaggatggtcttgaactgctgggctcatgtgatccttctaccttggcctcccaaagtgatggagttacaggtgtaagccactatgcctagcctgagtactattattattattattactttaccgtttctgtcaagtataacttataagtagtaaagttaaccttttctgtatttggttctatgaggttagaccaacacaaatagccccctaaaaccaccatccaaatcaacatgtcacatggttctgtcccccctcagatctttcttgtgccttttgtggtcaaccgctccccaccgcagaccctggcaagcaccgatctgttttcatccctagagttctgcctttgccaggatgtcatatcatgggatcctagagtatacacagcccttcagactaacttctttcatgtagcatagtggatgtgcgattcatccaccttgctgcatggatcaattgtgggcctccttttatactataagacagtatagggtagtacagtataagatttatatattgtatacagtatatatatatatatacacacacacatagagagagtatagtatagagtagtataataacgtattgtagcatagtatatatagatagtatagtgtagtataaggtaatataggatagtataatatagggtagtgtatattttatagtatatatagtatacatatatagtatagtcaagtatggtaactatagcacagtatagtttagtccactgtatagtatagtaaataaagtatagcaaagcataatgtacaatatagtatgatatatacagaacactatagtatatagtataggaaagggaagtataatgtactatcacaaagtatgtatggtctagtatatgtacatagtgtcatatggtttaatgcagtagaatatacatgatatcgtataatatgtaatatagtatatagagtgtattatagcataataaatagagtgtagtttagtatacatgatgtatatagggcacatatatagtatatgtatatagtacatagactgtgtagtgccctgtataatctagcatagtatagtatattgtatttactacatagtgtagtgtaatttcatgtaatttaccaaggaatcagattgctggtctttgaacgccagacctgccacttcctagctgggtgactttggtcaaattgcttaaccctctacttaagccttaattttaccgttgataaaatgggaattcacagggtagttttgaagattaagtgttagtatatgcaatgtactttgaacaatctttgtcacacagtaagtgtgataaaagagttatgattatttttagtggtggtagttgaattcactacttcattcaacaacatatattgaggacctactgcagacaatacattgtgttattaatagttttggggcatcaagagatgaccaggacaccgtgaaataccaaaagcttgggctcaggagtcagctgtgggtttggggatgctccatccctttctggttgcatgacctctggccggtccctcaccgctgagagcctgctgcctcatctgtgtgaggtcttagactgccatcccacccggtcctcactgcagcccacgaggttgacgccactgtcgctctcaggctacagaggaggctgctgaagcccagcgagcccaagccacttcagtcaaattcctgccagtaagtggggtgccggcttctgtccccgatctctgaaccctgagctgggtaaaggccattccccaacccctccatttaccgtgcattgtaatcgcttgttgctgtgattagagcacaaactccccatggcacagcggtgcccgactcatctctgcacctttacaacccagggcaggggctaactaaataatactcacaaaatagcctttcctgactagttaaacctcacaagcattgctctaagggcattgtacactactgcccttcatcttcatgctaaccctgtgacgtcagcaccattcacttcattgatctggtatctgaaactcagcaagatgacaggtccaagctcactcagccactagatgagagctaggttcaagtccaggaacaagcttcttgcaagtgtctagagcctggtctcaggctggccacgggtggcagccatccatcctgcctctgtttgcccagcgtgccttgccgtggatcctggttcacccaggctccaccctgcccagtcaactcacctctattaaagcttacttccccgaggtttccatcctttaggttccatgagcttgatcttggggcttgatggactaaacagcaaactcagatggccaagtggctgccacgggcctgaactttgcaatagatgaacttgtacaagcattttcttcatttattaaaaaaaaattagatgctggcatttaaaaattaggtatttgctcttaaaaattctccacctttgttattttctcttgactaaatggacaggtcctgccacaatgggtctgcagtcccccaaggtaacatgtggctggtgctgaggaggggcaccccctttaggtgggcacctgcccttcaggtagccacagaccacacctgactcactggcctcatacatacacatgcccttctggcctcactgggactccaccttggaggccagagacataaatgcaacccctttcctgccttatataccaggactacacgtcacagttcacaaggccaaaccagacccattctcttacctgttctctctccagcccagtgaggtggacagtgattattattcaccctattttacagatgcagaaactgaggctccaagatgacctaggactaggtcatgcggtaacggcctggccactttgacttggaatctggccctcagctcacctgttgtccccggctctcttctgttcactgcccgctctttccaaccctcggtctcaggctccttgcagtgactgcgctgattgtcacaagcctcggttcagcccacaccagtgtggacagatgtcttcccttttcaagcctccatttgttcacctgctaaacctgcctgcagattgcgctgcacacaatctagcacttcaggggctcatgaaaatgggaaaggggaaggctgggaaagggccatcaaagaagtggtgcttaggggaagggagaaacccagtcttccatcaatcagaatagtttcacttttatcatatgtgtctgtgtgtgcgtatatgcatatatccgcacacacacacacacacacccaggttttgtgacattttcttttgtaaacaaaaaagtccctttgctcaaaaagaaaggaaaatgttttcaaacagttggactttgtgaatgccaagggcttccttccagttcttttcagatttttgaaaaccaagtgggttgctctcagttagaactcaagtagcatgatggagaaggaggaaaaaaggacctgactaacgaggacgtcactgtgagacaaagatcatgcagggatcggcctgcggtgtgtctcatttcctgtgggtaacaggcaccacaatagttctgtgggtggtgacaggctcggctgccagcattcccctcccaggaaggcggtcaggcaaccctggggaatgtgtccagcttgaaagtcttcgaggcttggtctttggaaagcggcagggaagcccccctccgtcctccatcattgctggaggccttgtgacactgggacgatgcaggacttggggtctagggggcctgagctgaatgctgcctctgtctctgacaacctgtggaatgttcagcaaaagacacagcttcttggaggcctggcttatgtgtctgggaggtgtggcagaagcagtcccagcctgaagggatgctgccatcctaaagagatgaggtctgtaaaggagtgtggtcccagaggagggactcggtgtctagaactgtaattagtgtctcaaacctgtccacttcttgtcacttcttcaggaatcaccaggccaatctccatcagctctcccaagaaatatgacctgtattaactagctcctaatgaccttcaacagccattctccaccacagcagcaaaataaaatcttcgaatgttatcaacaggggccaagacttcttacttaatatctgtgagtagcttccctgctcagataggattatgtctgcattccttgcacagcccgtacagcctgcatgaggaggtccccgcccacggctccaatcttacttccatcattctccccctaccctacctctccaccctcagcaaccacggccttgtttctcttcctgaaatgtactaagctcactaagctcattcccacccccgtgcctttgccagggctgtcccctcctcctggaagaaagagccttgctctcttcctgtctggcacctttaacctttcctgtctcatctcagatgtatctcctcagagacaattttgggatccaccgattaaaagtagcacaccccgcccccagacacactcaggcaaaagtagcacacacccccccatccatactcaggcaaactctatcgcgggaccttgtttatttccctcagtgatctcccagacctacaattttgttggcaaattttgtctttaattttgtaattttaacgttgtagttttaataattttaaccttgtttttaaacttatctactaatactttttagctgcatgcttccccttcgaatatgaacccctgatgtcagggaccctgtcccctttgtttgctgaatatacctccagcgcctagttcaaggcttggcacatgtttctgcaaagggccagttggcaaaaattttaagccttatgagccatgcagtctagtcaactagtcaacccaaccagtcaaccctagtcatgcaactagtcaaccctcatgtttttgtgtgaaagcagctagacaacatgtaaatgaatgaacatggcaatgttccaataaaaatttatttatagaaacaagggttgcatttttaatacccctggtctagctcactgccaggattctaaatattctacaaatatttgttaagtgaatgaccagattattagaaatcatctgaacttttccataccatctttctttttcagccttcgtacctattgtagaggctggcttctattaaaataattagaagccacagtgtaaatcattccctgggtggtgttcattttaaatgaatgaataaatcatgggttaaaaacgtgtaaactaagaccaggcatggtggctcatgcctgtaatcccagcactttgggaggctgaggcgggcggatcactcgagctcgggagttcgagaccagcttgagcaacatggagaaacccgtctctactaaaaatacaaaattagccaggcgtggtggcgcatgcctgtaatcccagctactcgggagactgaagcaagagaatcgcttgaacccgggatgcggaggttgcggtgagccgagattgcaccattgcactccagcctgggcaacaagagcgaaactccatctcaaaaaaacaaaagaagtaaactacaagaaatccaaatactttccccaacatctttcctggtcctttaggaacttgctactcaaagtgtgatccctggatcagcagcttttgtagcatcaatcaggagctttgtggcatcccaagttggaccccaaaactactcaatcagaatgtgtgttaatagatccctgggtgattcgtgtgcacagtacattttgagaagacttgcgttggcaaatccaatacagcctcacccacttgggtgaagtccttctctcagggctacaaactggcattcttgctttacatcaacatctgccttcctcacatcaatgaaaccactgcaaggactacatgattagtttgaagactgcactacacccagaaagaagaagctaataaggaactattacatcttgtgggataggagagagaagctatgagtgtgaatgtgctttagatggaatgcttaataaatatttttggaagaaaaatgaaagaaggaagaagggaaaaaaggaaggaaggaagggaagaaatttcagtggtttccatatgtaaatcaaatgattagtggatacccactttcagtgtctccattctcaaagtgggtattttttaaacatgcaagtagaaattgttaagtgtggttaaagttgagtacaatgttttatcgaagggtaacaatttcaagtaatgtattccaactttatatatcatattttggtatctattattttaatctcatccattcattcctttgtctatcaagcacctgctgtttatgcagtcctatttcaagtccttgagatacagccttgaacctgaaaggtggtgccctgccctcatggagctgggagtccagtggtgaagaggggcttccattttgtagaggagagtaaaataagcacatctaaaacacctccccaccagtctgcctaaaattgcaagcagtaaaaaaatttcctctgcatctagcagccattgattctatagtccatggagtaacacaattgtgcatttatacccctgttaaattaaataagcaggaggcctttagcctgaggcagtctccttactcccagtgtctatgtaacaaactgcaaccacatttagtaagtaaacaaaccaaaacctaccttatgagtatccttttttttgtaacaaatagccatgttgcagccaatcacaaatagctgagcttcagccaatcacaggcaaccaattgatcagaccattcccaaataaggcagacaactcatcacatcgtgaccaaataaggcaaacacctcattgtacccaatcagataagttttctactttgcttccatgtttggcctataaaatcttactgctcatgccactgggcagtgctctctgaacctctttgggttttgagtgctgcccaattcatgaactgttctttgctcacaacataaagtgtgtttaaatttgatttgtctaatttttttaacacgtcaaattggtataatataatgtaaataaaatcagccaataatgcattcattcattcattcattcaacaaatattacccagagcatctgctacgcacaagacactgaacaaaactgatgatgatgttgatggtgatgatgacgattacttctacatgctgattgctccctaggtctcaggcactgtgctaggtgactagatgcagtatctcacctgtttcatgaactctatgagttaggcatcattatgtatgaacagataaaaaatctggttcagagaggcaataatttgctcaaggtctcagcttgtaaaatggagaaggattgaacctgctggaagtcacatagcagttcaaaaaccctgagtgatagacccgggatcccagtgtgaagagccacatgtagaatttgaaaaactgactggggcagatggtgttggggaaggagagagcccagaaagaagaggcaaaaaaaatccacctaccaggcctttaaagaagcccccaagggactgctgccgcttctcaggtctcttttggagcttgtccccattctgcagtgagttcgtgtccaccgtggcctgctctgtgcactgggctggttctttggcttcctgcttgttgctcttctgcttgttcatctcggctgctgacttcttgtccttcgaggagccctctttacccttctgtggtgctcctgttggttcaggctctggcggtgtgatagtcttttctgtggagtctgatgtctacagcaatttcaaacaaagtacatttttagtggctgcaggacaactctcaatagcaagggaataaatatgttaaaacagagatgttcaaatgttgggtggtatctacattttcatgaatcctaggtgaaatgaatataaaaaaaggtaaaatgtgcacttatgaagtcatggtggggacatttatttagttatctaataattcattaatacattttatgctatcccagaaagcactctttatcccttattctggaaccagaacttggcttttccttggggaaacacccttcttcctcatctactccgtgtggtccaggcaaactatttccacctccagacaagagcatgtgacttaggcctgactaatcagagcattgtatatgattggccagctgtgattggctcagcatagccaaatgcagataacactggagctaatctcagagctttgctgaaatgagagagaggctggttccctttctgttagatctgaagctgtgaaaatgtaagactggagcttccagaaccaccaatatttctagggaaaatctccccgaaaaggaagccaacacagagaaaatcacagctgagaaatggagagagagagagagagagagagagagagagagagagagagggaccaggcattgatggtatcatgcgtgcctcctagatctagctgttcctggagcccttttatgcttaagccagctttgaaggggctactcccacttgcaaccacatgcgagtgttttcctggggatgcccattcttttcttcataattacatctaccctaatttttggtgtgaaattgtccttttgcttcatgaaatggtggtaaaagagatgattgttttattagtttggaatgtatatcgttttttgtcaaactgaaaggtttacaatcccacatgcttccaataatttgatgagatgaggctgtaaaatccaaaaatctagtaaatgcaggctggggtaagaataaccatgtggatatcttatttctccagctgcaaaagcaacaaaggtccaaaaaaatatttctccagtataagaaaagcaccagttcaagcaaggctggctttgatgttggggagaaaatttagagcaggggagactgaatgttacatgccctgtccaaagggcaacagttgctctgatccagccaagagataccacgtaggcttgcagccccagtgtggtcagagcttctgttgtttcaagacaaccttgaaattaaattttaaaaaatgcaaaatgtcaacttttaaatattgacttcaaaagttttaaagccctgattgtggcaactggcaaacacacttgacccaccggatacatgtgtataagcatgattcatgaagttatgtactgtacccaggtaaaaagttctacaacaaggtagcagctttgatggagaaggcatcaactgtaggagaactttcttttcacaccagtgaatcatgcacgccccttagaagtaagcgggaagacaaacagcagagactccccggtccagaaggcctccaccggtgctcttcagagggcagaagtccttggagaaagaagcaacaggcatccagtgtaccttgagaagctcttctgtaatatatgtcttgaacacttctggcagaccccaactgtcagagttgcagcaaatgctaagatatggatgtccaagtacaatagatatcccagagcagatactctccttagaatgaaacagaaactctcaccacaatgctcttcagaaaggccagaaaccagagatcccagttcaaatgccttgttaactgtttttgttgtgtagaagattttaagatgcagtgagtggctaagaactcagtgtctggagtcagaaggacctggtttgtttctaattccaccataaccttgctgtgtgaccaaggataaactgacctcctagtttcctcatctctatgggagcaataaaagaaatgacaccttatggtgctgtgagaattaaattagctaaaaatggaaaggacacaccagtgttctcaagtctgaatccaaggctccggaaaataaaattcccaattggattctgaaaacactcctaggtgggatgtttctagcttatttggatttgtatggatgtcattccaattttagaatcaccaagattattggcataattccttcactgtaaaattccagacaaaatataccatcatatttaagcttgtcttaaaagcttaaatatgaagagtatagtaaaaagcaatatatttcctgtttaaaaatgtaggataaaccaattattatggaaataaaaatacaaaaacatatttacagtcattaccgtccatttgtgagtgtgatatgggcaacattataagatggaaattccctatcagcagcataatagtaatagtaacatatagacactgttaacaatagagttgtgcccccaccccaacgcatatgttgaatccttaactcccaatgtgattatatttggaataggaagtaattaaggttaaacaaaggcatagggtggggccctgccccaataggattagtgtccttataagaagagacattggcaagcttattctctttctctctctgccgtgtaaggacacacaagcaagaaggtggccatttacaaaccaggaagagagtcctcaccaggaaccaaaccctgctgatttggttactccttaatcctatcctttccagccacaagaactgcaagaaaataaatttctgcttttaaagcaaccacctatggcattttgttatggcagcccgtgctgactaatacagtagctaacatgtattgagccctctataccagaaatgttctaagtgttttacatgtattgattcatctaagtatgacaaccccataaggaagtacttttcatagctcctttatatagatgaggaaactgaggtgctgacagatttggcaatttgcctaagtcacacagcaaaaaaaaaaaaaagtggctgagccaggatttgaaccagacagtttgagtctaccactcattcttgtagccacttctctatattgtcaaaactactagaagaatatttgatgccattttttgtggaggtgtatttttaaattaaaaaaagagtgcagctgcatgatcctatttaaaaaaaggaacacatgtagttataaatatgtcatagctatgtttctttagaataaagaaaataatgaaagcaaactgtgtgaccccccgactccatgtctttattctgttcaagacatagattctagtacttgccaaacaccatgcaaggtgatagagaaatagaagaaggagacttcttgctccacagacattccagacagacatgagaagaaacaggggagataaatgaattattacaatttgtgatgacgctatgaaataaaagaacaatatgtagttatgagaggcagatatggaaggtctttttgaagaggtgacatttatggcaaaaagtgaagggtgagaagagatttttaatgcagaaaagagggaagcacatgtgtgaaagttttttgataggataaagctgaggaactctagcttgttcatgcttgtgtctgcagaccccaacatagttcttggcatatagtaggtgcttaatcctgagatattaaatgagttggctgtggctgagaattttattgaaaagtatactgtgaagaagtgagaatacaccactaatcccaccaccaaactgagttcgaggtcacttacttggcagctggagtctttcccatttatttcttctgagtgggtgatccctccatcccctttcactgactaaaataacaaacagacaatggccttcagccacaagtacagtgacgtggagaatgcaagaaagttctgaaatggatgatctcagtcatttatcattgaggtttggggtcaagacaaatggaaggccaactggaaacatgttactcattggatatagagatttccatgcaatttctaaccagatctaattaaattcaagtgttggcctccaaaaataacaacaaaagtactaaatcctggaattaggcaattctgagataaatgatgacggttccaattaatgttggaagcaggagatagttgaacatattaaatgaagactgaatgaacaattgacccatgagtagccttccactgggaatatttaggctgtgggtgttttattgtttttttttttttctctccttgatagagatatgagttttgtttaatatttcattttccaccctttagcaccccctatagccagcaacaccagtgacagggataaaaggggttggacttgactccttaaactccacactctaagctaatggttctagaagtatgattccaggaccagcagcttcagcatcacctgggaacttgctagaaaggcaaattctggagacccaggctggatctaatcaatcagaagctttcagaggcagaggctcaatgatctgcattttaataagctctccaggtggtgctgaggattgtctgagtttgagtaccaccgctctcagcaagttggccatatacaggttcagactcatgctggggtctgtggttttaacggtgcatttagtaatgtcctatgcttagtgcctgatacctaagaaacctggtgataaaatgttcggttcttatcaacaacattgactcaggtctaattcccacacgtttgatcactgcttaatgtctcctcttcccagctaagggaggagtatagagagcagggtttcagccatatggggcaaagaggaagactccagattccactgttatttatggccatggctgttctcttagcagaccgtaagaatccacaacacatgcactaagaacagccagaaacattgaaagcactcaaatactttttgactgattaatattatgtatctttgttgtctgagctacggtgttcacattagagataatacaaattattatttatgaaggataatttttagtggagtgcttactaagtgctgggcattgtgctaaatgagataataacttgcattatttcatttattcattatgtcagaaccttaagatagtggaattactttatttttcagacaaggaaatggaagctcaaagatactagcatcaccatggaactagcaggtttgagtgccagtgttggacagcaggcaatgactccatattccacactctaaaccacctccccatactgcccctagaaggcaagaggcaccactcaatcaataaacgtttattgagcattcactgtatgaagttgctgaatgttagattaaacaaaatgataaaagcttggataagatggaggatgaccaaactcaaatgtggatgtttatgggatgtcccctcatcaggagtcaactgtgctcttctttatttttgatattattattgtttttaagagacagggtcccattctgtcactcaggctggagtacagcggcacaatcatcattaacagcagcttcaacctccatggtcaagcaatcctcctgcctcagcctcccagatagataggactacaggtgtacaccaccatgtccagctatttttttttttttttgagagagagtctcactctcttgcccaagctggagtgcagtggcatgatcttggctcactgcagcttctgcctcccaggttcaagaaattctcctgcttcagcctcccaagtagttgggactacaggcgcctgccaacacgccctgctaatttttgtatttttagtagagacagggtttcaccatgttggccaggctggtctcaaactcctgacctcaaatgatccacccgcctcggcctcccaaagtgttaggattacaggcgtgagccactgtgcttggcccagctattttttaaaaaatttttttgcagagacagagtctcactatgttgcccaggttggtctcgagctcctgggctcaagtgatcctccagccttggcctcccaaagcactgggattacagaagggttgtgctctttttaatatactgcttagtgtgaaagaggtggtgtctggaagttccgtgtactgaggaacatcattggtgcaggtttcactaagattgacaaacaaagatcagactgtcctctccataaaatttagatctgtctacatggaaagtgggtttttccttcctccgtgccttgtgcattgttctacaaaggccagtcttgcttgagaaggtttagaaaaagaaatgaactgttggctatttcttccctcctcataaccagctctgtcagccttcccatcacacccaaagctttggacacgtaaggatttcattcagcctccaaattcgggctgtgtcgtaagagcccttcctactcaagcccattcccaagtggcctttacactgtggctttggatcatatctgtcaacctttgggaatgttgagcagcaaaaaacaaacaaatgcacaaaatggctttttaggcaaaaaccgaatggacatgaagagtcacgcatgagcactccaccaccttctagagaataaagttctctcacttgccccctaggagacaggaattctaaacttcccgttagttgtttcaatttggcattcattagggactctgtcaatttaaggtttcaatttgctttctttccccccatttctttgagagcccttggagaagaattgggattgaatcagaaggctgtgttgacagcagctgatctcagctgacatcatgaatcatgaaaacagacctccaggctgtcagggagattactgcaacaaagttcaacttcttaaaaaaaaaaaaaaaaaaaaaaaaaaagagagagagagtatctcaaacttttcagtgatttttctttattgcttattttgaggcatgtaaagctgtatgtatgcaaaggtgactgaagtttgggtttacacttagaatcttattaaatccatctgaagtcacttctgtagcagcagttattattaataacaactgtttccttccttccttccttccttctttccttccttccttcctctcgtcctctctctctccctcacttccctccttttcttctacccttctttcttttttctttgcagagacaaatcagaataattcatgttgaactctgtattcaaaggaaccataaacatagaaacttattttttccagctgtcaaaaatagcaaagttactgtttaaagagactaaaattcttccagagactatttaatactttgaagaacagtttaaagactatgaagtaatttcagagattttccagtgtgatattgagcaactttcttcatggagttaatttttattcatgacagtcaaaggtgaagtatctcagggcattcagcctgcagtgttgagatggaatctacttgtggcattcacgccttgtatattaatgaaatcattttttatttctttcatcttgtcatgcattcctatagcttgatactctgaggaatgtttgaaccatctccaatgtatatcacttagctattcaaaaatctagcaaaagtgtttggtggtcagttcacatttctttgaagggaatgttaatgtattttgatggcaatataattcaaacacaattgacatttaaaagaaaaagaattgggctgaaaatttaatatatggtgactatatctgcaatattgtttatcagaccagtctcatgaaaacaaatccaagaatgggatctactgaaaatttctaggatcaacaaaggtaatggatctgagcttagtattttaccacaatgctcacttgaaatggaattggactagtcaggcaaaattccccagccaaggtaaattttgttttagtgacaaatatatttagaaaacctatgtgcaagctttaagtaagccatatattaattttcttctcctttcccttattgtcattttaggtaagtgcaacagctcaatgcatcaaaatggtacttccatagaacacattactaaagaaatcacaacaatggagcatgtggttgttctaccttcgtatcctttctgagaataccagctgcagaagcacaggaagcagcaattacacatgagtcaaagggtgagctttagaacaacaaaatgacaacaaaacaacaaactgagttggaattctggctctcccgcttaccagctcccggaccgtggaaaaatcccataaatactcactagtctctgtgtccttatgtccatcatggggcagagagagcacttgtttcctagagttctctattaataaatgagatactgcgtgcaaagtgcctagcagacaataaataaacggtagctctcattgttgttactgccgataactgaaaagtgctgaacgactacagagaccctcttagggtagaaaggaatgcaagtcattggtagggacaggaattgaccaaattaatgcttccttcagaaatctttccttaaagagcaaatcagtattaacattttaatgctcagagaagaatttcatatggaagactttcggttttctgttttgtaactaccgtcacagaccaccctctttccacctccaatagtacatttcaacagattttgttagacttactagattgaatgtaattaatttaaaaaaccctctgatttcatggctgcctcctcatttggacttttaatttacccattattaaagctcacagtatttctctaagcctgagaacattattccaacaaagattttcttacaaatctaatggtccaaagaaagatatgaggaggagtaaatgaaataaggtaggtgaaaatagtttggaggaggaaagcattttcaagtgtaaggtgttattaatattgacgaagtataaaactgtatctagatctaccacctttctggtttcatttgcctacctgctttgtggacacatgaatgcagtattctacccactcactttataaaaatacaccagcacttcaaatattcaatttcttgacatacagctgaattaatatgtataagaatcttttcctatttagggcatgacagatgtcttagatattcctcgcaattgtttaaaatcctgcaggagcccgcaggatttctgtgaagtgctacatctctatgtgttgaatgcactgttaggacttacatgattctgttttcctttccctaaaatatagttattttaaaaatgatacttttcctatttttatttatttatttaagacggagtctcgctctgtcgcccaggctggagtgcagtggcgcgatctcagctcactgcaagctctgcctcccggattcacgccattctcctgcctcagcctcctgagtagctgggactacaggcgcccgccaccatgcccggctagttttttgtatttttagtagagacagggtttcaccgtgttagccaggatggtctcgatctcctgacctcgtaatccacccgcctcggcctcccaaagtgctgggattacaggcgtgagccaccgcgcctggcctctatttttatttttatgagcagtaaatttctagagagaaaaagatctctagctggatgcagtggctcatgcctataatcccagcactttgggagtccgaggcgggtggatcacctgagatcaggagtttgagaccagcctggccaatatggtgaaaccctgtctcttctaaaaacacaaaattagccaggtgtgttggcatacgcttgtaatcccagctactcgggaggctgagacaggagactcacttgaactcgggaggcagaggttgcagcgggcagagattgtgccattgcactccagcctgggggacaaagcgagactgtctcaaaaagaaaaaaaaaagaaaaaggagggaaatgcaaaggatagaaagcagaaaatcaatgatttggtgaatcaaagcataggttttgcagctgagttctctcttccattaaatcaattatttaaacaaatcgatattttgctaacaatatccaaaatttgtctgaaacgtttatttatttggctcaacatccccaaccgctcaaaaaacccttagcgatgggccagatgttgtctctattttcaagctgttagggcaggttttttctttcctgcataaatccgaagactttgaatcagtttggaagctatgaacatgttactaaaaagtatttcctaagaatgattgctagagccaacttccagaaatctacccaatggggacattaacacatgtgcatagaagtaagtgtgtgaggatcttcatacaggcttgcgaagcagctgaaataacgtgggtgagacacttggtgtgtgctcactgaatatgaggatagagttaaaactaaatgtctgttttattctccgccgggggagactgcacctgtttacgctcactgttgtatcccttgtgcctggaacatagtggacactcaataattatttgttgaaaaagtgaatgcatgaaatgcaaaaagttgaaaacataccacatgtccatccattgagcaatggttaacctgagtatgataaatccagacaatatgattcaaataagttgttctaaagaatcaggcggttctctatcagggattgcaaactcaaatacccacagggaaagggccggtaacataaatgagtgagctagactgggtgtggcaatagggagtggtagggactttagtaagctggaaaactcttcatttgtttatttgaattaatcacagtataaatatagtgttgtaatgaaggcaaaacagaaaaaaagacgataattagaatacctggaattttaaagtaaattccaacaatcaggatttaaattttgcaaagataatgttcgtgttcccaggccttttcgtgggcaactggtaataagaacaatggacagcatggaatccaattctaagaatccattggggattgctggggaaaagtgtgtcctcacctaccttcatccctatcctatagcgaattgattccaaaggacgcttttcttttcaatttgtttccctcagaatttagacttacccattttctactgccaaaaacttttcccaaacagcatctaacagatagctctgggggataaatttaagtaatatgagacctcattagaatttaagaatttgttttagatggatgctgtgagtggtttagaggtttttttttttttcatgctttctttggagtttcttgtacttttccctgttttaaatgaaggagcttcatgttggttatttggaagagaccatcattctatttactgttttttttttctgtacctctcaattccatccagaaatggaaaagctgatcactctcaatattatgatgagatatttggggatcccatttgtaagttagatgagttgccggaaacaggccaaatgttcttttctttcctggcatcatgtaaaaattggttttaaaaaaaatctcaagtcttaatctccattttcactgccaaattgcagatcaaatggccaatgagatagatggggttttggccatatgggccgcccacaactgattctacactttttactccatgagaatataacaggaaaagaaaatgattcctgtcaacaatttctaacataattatttctaatatgcctcagttcccattggcaagggttttgttttgttttgttttgtgggctagatagaattccttaacaggttgagcctgtgaaattagagagttgctttctcaaaggattaaactccaaatactcctgaaaataaagtcacactataatgaaattcttgtttttcattaaaagagaattaaactaatgaccttttacatgcatttttgttttttgttctccaactgatttaggttttgttgcattatattatttaagctcctggctgtttagtcatttaatgtgcattgctttttataaacagtaaatatatctatcacattctttctattctacacaaattaaaagcatggctaattcatcaactaagttatatatttcactattggaatattatgttgtcatttccttatttaatttatctataagctagttttgtccaaatttgtgtcactcacgtcaccttcagaatttttgccatatctttatataacttggactatttgatacataatccttaaaatgcctgatattctttatgtaaacaaatgtaattcaaagaaaacctcatatcattaccataataagaaaagcagtatcattgaccaccaagagaaggaaactttaaaaataaataatagtaagcaataatagtaacttccagttagatgctgttgtatgccaaaatttggacgcaaccacaattaaaaggccgaaaaaaagaaatagatgttggcgtggaggtggtgaaaacggaacacttttacactgtaggtgggaatgtgaactagtacaaccactatagaaaacagtgtggagattccttaaaaaactaaaagtagatccactattcgatccagcaatcccactactgggtatctacccaaaggaaaataagtcattatctgaaaaagacacctgcacacacaggtttattgcagcacaattcacaattgcaaagatatggaaccaacctaagtgcccatcaaccaatgagtggataaagaaaatgtggcttatgtacaccatggaatactactcagccagaaaaaggaatgaaataatgtcttttgcagcaacttggatagagctggaggccattattctaagtgaagtaactcaggaatggaaaaccaaatactgtatgttctcactcataattgggggctaagctacgaggatgcaaaagcataaaaaatgatataatggactttggggactcaggggagaaggttgggagaagggtgagggataaaagactgcatactggctgtagtgcacactgctcgggtgacaggtgcactaaagtctcagaaatcacactaaagaactaatccatgtaatctcaaatcacttgtatgctcacaactattgaaataaaaaaaattccaacccaagggcacctctttttttgttaaaaagtgttagcaggcattaaagaagggttaaagaatattagcaataaactgagactttctgtatgattgaatcagaaggaagaaagggaattttctcactatgcaatccatattccattcacattccatacacaccagctacaattatgtctcctactacctgtggcatgagcccattgttcccagaagccgctctaggtatcttaggtttcctatactggaagtaaggggcttaccatttgtctgagaaacgccatcagagaggttcttggtttgctttcttctcttttgagtttcgcttctgtgggttcaggtgcagcatctccttcgttgaggtccactgtttgtaaggctgattctacttccttggactttataatctctactggtgactcacacaccacctggattattttgccaggtaataagaaaatgaaaaacaaaacattcccccaaaacatgttttacaaagtggggtccttgttgcccccctgtccacatagtagctacagttttgaatctatgaccatttctacacaggcacatcttggagaagtaatgcttatgttgtacaacgcaccaatttccaagctcaactgccacattgacatggaagtggcaaaatcccttccccaaggggaagaacagataagaggtcctttttggggactgtcattcagagcatgctcaatacccaatcaaatctagtaagcccacctctttaatctgccacgtaggtgaattacatttggcctgtctagaaaccaggaataatcattttcttaagagtccaacgttagagacggtaaccatgacagcttccagttctctttccagttcccctgcaactataaagaaactgtcctctttgtagaaaggagagtgtaaaaaccactgaatttaattgacttcctcattaagcgatatctaatttttccctagaacagtcatttgccatttcacttaattgaagtttatgctttcagaagaaaaatgaacttggcaagaaactgatggctaagttgttcgcggccctggccactgtacctagtgagctcgatttcctctgcctctgagtgtctgtggcggcttggatggaagggcccatctaccacactctgctctcaacttgtgttcttttgcagtgcctcactccatttgtacagggccccagtcacatctgggacagtttctgcatttgtgttgttccctgccacaggacagagtgaattggccaggagaggttttttaatttcctttgtttcctcaggcaggggctggcaaaatactaccaaatccagctcagtaactgtttctgtgtggctcctgggctaaggatagtctttaccttttaattttatttatttatttaagaaatgaggtcgtgctacgttgcccatgctggctttcaactcctgggctcgagtgatcctcctaccttggcctgccacgtagctgagactatcagcacacgcgaccacgcctgatggattttacgcatttaaagcgttggaagaaatattttaaaagataaaatgtatgggatggagaccacaaatggcctatgaagcctgaaatatttactatctggccctttaaaccacatggctttcatctgctgcctccctggaaagtaccatagagtcaaaggcatcttcccacttgtctttgctgggccagacccctagcttcttggagccttgttcttggtgtcagggggtaggggaaggggacttagttatttccaaaaatatcgtctgctgagaaactattttctttcccatcatacagaacataccattggtttgcaaaatgacccgaattttccaaatcgagaagaacccttagtctctgtattgccatttgattcagggagttgcccatcagtaaatcagcatgcagaacaccccaacatttggcaactaaatcacatttcttaagctaaattaaatttcttaagctactgacacaatttctagtattttcttttttgtaaacaaaaacggaagttggggggttacaaactcaaaagtcctcaggaggcaaggcagagaatatcagcatggattgaccagacctaagaccaaaagtagtgacagggatgatgacaaagtaaagtcaagctgtcccatctaaagatgttaaatgattaaaaatgctggattggccaaacaaaacctatttgtgaggaagggtctgctgctgggctgttggctttggaccccaatctatctttaggaaacgaggtggagactggagccatatcagagactgagaatggcaatagagcatggacatggatttccacattttgaactgatttaattcaatcgcatttccgaaaagtaagtgtgagccacaagagcccttcaggtgaggctgaaatataggcaatctaactcgtggtcatagaggacaagctccagaacaacttgctgggctctaaatcacatctatatccctcatctaagctcagtgcccaacatctctgtgcttttcgtgttctctgttctcggtgggaattgcatacacatcagaaagttgtctgcatattaaatcaggcaatacatgtcaagttcttagcaccatgcactcaattaatgctagtggttgttatttgtgttaatgttagagctatttagtccatgagcatgaattatctggattaggcaccatgcacatatccaatatttagagatgattatattaatagctacttcttgctatgcctggtattgtaccgggtgtttaatatttttttataaatagcatcaagatagttcgacagcttaggaaatataacattatccctattctatagataaagagtgaacaattgaatgatttggccagagtcttaccacagataaataggcattacaataaggatggcattttctgcggcaactcaatgtatctaatagtggcttaaccaatgaaaacatggaacaagaagttctggggttggttgagtggctccacaatatctctaacaactttggctctttgttcttggctccactattcttggcatgctagattttcatcattttatttgttacctcatggttaaaaaatagctgccacaattccagatatcacatcctcaatccaatgttctgagaaggaaggtcacagccaaagacttgcaccaaataaacatctgtattttgatcccctacctcagggtacctaaatttcatgggtcagagctaggccacttacccccaggctacttactagtgaagaaaatgagattactaacttagactaatcatgatcaaatactttgggggtataaagttggcaactttgcctaaaactaagggtagaagagtggagaaatagaaaatagctcttaagtagataaggaatagagtttgcgttcagaagtattctgtctttgaggcagtgagttctttcttcgtgtgcaaagacctggaggaaaaattactcataaataaaatgatcagattgtatggcaataactctgtaaatcaattctatttggatgccagtggttcccttgctgagcctttccaaatgttgagaggtatcaacccataaatcctaggccacaagtccattctccagaacacaactattgcagtaggtaaaaaaatatagtacttctggagacttccactacctttgaagtcaggccaagaagctggcttttagtagccaaggaaaatccactgacatccagtgtggaaatccagaacaatcttggctaaataaggatctgatttgcatatacagacataggaattcaatttttatttggataattttccaaatttctcctaggccagggctttggaaaaagttgtttcctatttagaacatatgaccgcatctgcacattttaattttggatatcatgaatggacataattaaagtcagatgtgcgctacattttagaattaaatcccccctgcttgatttctgtagaggatatggtagacattgcatgaagatggcaggtacatctaacattgacaatatacatttcagtgaagagtttccctttttgcctcaaattttataccacacttattcttgaaatttggttatacagtttttactagagctgtggcttttggaaattgatttatggcaaatagatttcgtccatttaaacttcatgcacaacgtcatattaacattaaaggtttttattttagaatattttaaagattattttgataggacttttaatgtgattgattacaaagacctcccacagatttttttttttctactcagtaactattctctctcatctgcttacacactctaattttgctttgggagagcaatctttcccatcttcaagactatgtaatttggattaagccaattaaaaaggtctaaaccaatcaacatggtcaagctccttgactgtggttggtttagaaatgacagcatgcggcaaattgtattatttctccaattatttaccctaccttcctgtaaatgaattacacacctgtgcccattgatgtgtgacttgctttagtaatggaacatgggtagaaatgacatataccatgcctgagcagaagctttaggatccgttgcatgattcacccatgccactattttctctctgcaacaagaactgcatgtccttattgaagggactgctgcttctctactgacctcagcaggaagaggccacatgggttagccaaagccaactgatagctggcttgtagcatgagtgagaaaagaaaaaataaaacaaacttctttgctattgagaagcactgtaatttgggacctggttgtcactgcaacacaacctggcaaaagctgacgaatacagcatgtgaatgcatttcagtcagtgaaacagaacaaactccaggacatgcagggttgctacttgacaaatagctcatttactttggactgagtgatgtgatgttggaaagctgagcatgtagccaggccaagaaggctgaacccaaggagagccctgaattaaattttatttgaaagcaatttaactttctagtaatgagagccagtaaaggccactttctttctaatccaggttgaattgggttttctttcacttgcaactgagagattacttattaagagagataaacaacagaagtacctgtttccatggtcttacaggttattggaaggaaagaaatttttttcattagaacattaactcaattaaccaatgggcaaaatattttttttattacaactgaaagattctatcatttcaagagttaaaaaaagatttatttctgataggaccagaagcacattctaggaaaagcactaaacttccacaggcttcaaaatccttatttttctttctgtgagaaactttgagaaatgttgacatcactctgttttttagttttttttaaatacaagtgggccttgcatccgttgatagattagttctggaaagttgtaggtagagaaattttaaagaataaactcaaccacattttagccagaagtcgttatttaaagcactcttgtaatatggttaatcatatctaattgtcctgttgtgaaggtgtagagcactatacattgttttgactaatgccttctctcttatttaagagaggaggaaattaaagctaactctgttttacacattccttcaatccacatggacactgagtcagctgtgagctgtatcatttcactaggaaagaaaatcaccgattactgggacatgctcactcactatgttgtctcttatttgctaatttgctaacaattactgcagaaggtggcaaacttttcctgcaaagtccctgccaatcagtgtttctgttgaaactactcaactctgttgcctagcaacaaagcagccatagatgatatgtaaaggaattagcatggctgtgttctaataaaactttatttctggacactgaatttgaattttgaattcacatcataaaatattctttttaaattttttttcaaccattcaagaatgtaaaaatcatttttagcttgtgggctgtatttggcccatgagctacagtttgctgatccctaaaattattgagttcctcctacatttcaggcactgaagtaagcacgttatagacatgatctccaattttcacaagaacccgaaagtgtaggtgatattattatcgccatttaacagatgagtaaactgaggctcaagaggtgtggcctgaagatgatgggatcaacgtcacaaccatcagtctcattccctccaagtgataggctgtcagaagatgaaatactgatgctgggagtggtggctcacgcctgtaatcccagcactttgagaggccaaggtgggcggatcacttgaggtcaggagtttgagaccagcctggccaagatggtgaaaccctgtgtctactaaaaatacaaaaattagccaggcatggtggcgcatgcctgtaatcccagctacttgggaggctgaggcaggagaatcacttgaacctgggtgggtggaggttgcagtgagccgagattgcgccactgcactccagcctgggtgaaaagagcaaaactctgtctcaagaaaacaaacaaacacacaaacagaaaaaaagaagatgaaatattgagccttaaaaatcaaaatgttgcttgcagtgttaagtcatttaaggcaatttttataatgcttctttattttatttaacaaatattttaccttattttatgtccctatcatcagtttttgtgttatcgtttggtgtcgataatttaacttttaattcctgtttatatttctatttaaaatttcacagtagaaaatagaatatctcctgtttgcctgttagagatcaactctgcattttagcatctgagctgcgggaaacacagggttccttaaacaagcaactacacacaaacatccaaaaagtttttctttagaaaactcagaacctcaaagctaacagatgctacagattttacgggcagcttttaaacttaaagttcgtagaaagaagtcttgtggagtcctccttgtaggttgcgggaatagaaactttgactttctataaaatagtaattcatgagaactttctggaatgatgagagacctgagctttgctgggctaagattggctcaagaaagaaaagaaggaaggaaggaaggaggaaggaaggaagggcagtaaaaccaacaaacagattttgagaggtgaagccagctggatgtcctgggtcgagtggagacttggagaacttttctgtctagctagagaattgtaaatgtaccaatcagcactctgtaaaaatgcaccaatcagtgctctgtgtctagctaaaggattgtaaatgcaccagtcagcactttgtgtctagcttaaggatgtaaatgcaccaatcagcactctgtaaaaacacaccaatcagtgctctgtgtctagcaaaaggattgtaaatgcaccaatcagcactctgtaaaatggaccaatcagcactctgtaaaatggaccaattagcaggatgtgggcggggtcaaataacggagtaaaagctggccaccccagccagcagccacaacccgcttgggtccccttccacgctgtggaagctttgttctttccctcttcacaataaatcttgctgctgctcactctttgggtctgtgccacctttaagagctgtaacactcactgcgaaggtctgtggcttctttcttgaagtcagcgagaccaagaacccaccggaaggaaccaactccggacacaatttcaagatttttcttccaataagaatcataacacagccattctaatttttattccacatcacagacaacatttcagaaacgtgtttggatgtttaacatctgttcagttcccataactaaataaaaataaaaacacacgccctatttatggcaagtaaataagggacacccagaacaagttttgctttggcaacatgataatgttcggtttctatctcaaggagctgtgaattcacttatccctacttataaaaatttcccaaagactgcgcacttctttcaaggcagagagctgttgttttgggtctgaaactcacgaggtcaatttattaatctccctggaagctacgtttttgtgatgttttatatagcaccatccctttcggggatgaatgaactgtcttgaaaattttgacaattcctctagaagattaaaagccaggaaaactgtgaggctcaacgtctctatctcagaggtagacccgtcaagtcagcgctctaacctgagaccgacattctcagcgtctgttgctgcaagatgttctcatgcctgatgcaactccctgccctgggtaccgcccaaagttagtaagaagctggatcaccatggaaataagagtgaacgagcagtcaaggtggaatgaagcagaaggcggagcatcattatccctcaaggaagcgcaaagctgttcttacgtgtagtagactctttcagcccctactgataacaattataaaaatttgtgccctgattttgcatttattttgcactgattcaatgagagttacaaaaattcatccaatgttatcctccatgcgtccctaatcacatacgggataagagagtctacaacaaacgaatcacactggcagcatgcaagaacacaggaccccagagctgaaaatgcccaattgtacaacatggcggaagatgagaatggaatgattctgccgtggtgtgtgtaacttacattctcctccgcacctgtggggactgagtcctctttaactgactaaaggaagataaaaacaaaagtgagagttaaaaggttacagaaaacaaaattgttacataaaagcaaagggttagttgggctcacagtcttggggtgcgttcggggacactgaattgcctaggtacacctccttctaaaaagaaaggagacttacaaaaatgaaaacggtatatatatatatatatagttatgtattttaaaatgcaacaaagagaaaattaaaacacagatgcagccaggatacaaatggagcaagcagaagcgttgtcacagaaaatgctaactgctgtaggtaagcaatgtacttgcctttatattttttagtagttgatgaaaagagagaaatgcaattaatcattcaatacagagtcactgttaggtaaaacaaagaagctactcaggaaaattctggtaataagtgcagagaaactcgttcaattgtccttttgagcaagcaggctttataatacaataggcagggtccaagccctaccctgaccatagcacaggggccagcagcaggggccgctgctttcgtcagccctcagtctaggccaagttcattaggtcaaagttcaatttgactaaaacatgtctgtggaaggctagagagctgcagtcctacatatccacattcaaacaccgttttactcccaggagtaattctggcatatacagtcctgccccaagtgggataggagttatcccgattctgtcaaaggtcaaagccacaatcattctatcagttagccaactttggagttcatttttgcatctttcttttggtggttcttaaacttctggatggatggtggtggatgttacagaccactttgagactcatttgatagatctggactctcctcccagagaaatgcacataaacaatatactttgcaaataatttcaggattcatagaccttctatgtctctcctcttggattacaagttaagaactctgtctatatccattttgttactaagtcctatttttttttttcctttaaggcatccaggggaggggaagacaggaagtgatatttacaaatgtatcttctgcactaggcatcttgcgttatatatcatctcacttaaagcaccccaaaatggtaagtattgtgatcctaacttacagagtaagaaatagaagttcagagaggtgaagccacttgttccagttaaacagctagaaagtggtggaaatggttttaatacatttattttacatctaaaagccaaattttcccctgctatgatgacttcaagggtcagaaacacattttttcggcaatcgtgtgaattcctttcttcacatacagaattattctctctagatgagatcttcagattgcataatttatttctagttatcttcttcccacagtgaagtttctctgggcacaaaaatgttcctaaaagagattgctgaatttctgaaagcttctgattatcaggaaattgtaatgtgttcagaagaaattagcagtagtgttactgtattaatccgttttacactgctataaagatatacctgagactgggtaatttataaaggaaagaggcataatggactcacagttccacatggctggggaggactcaggaaacttacaatcatggtggaaggggaaacaggcacatcttacatggtggcaggcaagagagagcgaagggagaagagccccttataaagccatcagatcttgtgaaaactcacttgctatcaagaggacagcatgggggaaacttcccccatgatccaatcacctcctatcaggtccctcctttgacacctggggattatggggattacaatttgagatgagatttgggtggggacacagccaaaccatatcagatactttcttgaaactgcacccctttttctctgagattagtcagacactggttaataccatgaacacgtaatgaaccaaatggtatctttaaagccagacctcctcaaggccggcccacaaaagtttcaggaatcattatactgtttatattagactgagaaaacccttccattatttaagaacagcacttctaggtttacataccctttttcctgtcccagtttattgcaacaagactagtttttatctttgattgcctgtgtctagaaagtttctggttgttcattgctcactatatttcagaagcaactgggaacttggagtagattccatcaccaatgtagatgatggtgaggaatagaaggggctgcttctgaacagattttttaaatcttcattatggtttcagacctccacatctttctgatgttttaagtctggcattataaatattgtctttttcaaaaggaattgctattttatatttttaaagtcagactacttagcaaagcactcattttgggaaataatccagttgagcatctctcaaacttcaatgattttcataccatgttctaattctttttttaatttatttatttattattattatactttaagttttagggtacatgtgcacaatgtgcaggttagttacatatgtatacatgtgccatgctggtgcgctgcacccactaactcgtcatctagcattaggtatatctcccaatgatatccctcccccctccccccaccccacaacagtccccagagtgtgatgttccccttcctgtgtccatgtgttctcattgttcaattcccacctatgagtgagaatatgcagtgtttggttttttgtggaatactatgcagccataaaaaatgatgagttcacatcctttatagggacatggatgaaattggaaatcatcattctcagtcaactatcgcaagaacaaaaaaccatgttctaattcttgacctgtccatgtaccacctctattcagttgatgtttttctttaaactgactctctttttacttaaatatatttttacttaatatttttttcttaaatatattttaaaagaaatgccttatcattacagcaaatgtcatatcaacatctttgctgtaaatagtagtacgtattaaaaagtacaatagataaaaaacatgcagtaagttctaattgtttttaagtctttctttaaaaaagagatcagcaggtgtttgtacagtaataaatgcctgtgaatatcaagaagagacttcttatagaatgaaaacaggagataaatgcactatgtaaaggattaaatgcttctcagattgtgtccaagagtcactctaaataattttgaactattcttgtacatttgcacactggcctgcaagtgtagccttctgttagtggttgttgaaatatccagttaaaataagaattcaaaaatggataataagagggcaggttctgatccccctttagtgtttgacacatgtaaaagaaaatctgctcagaacccaagtctagagtaccatacactgtggaatcaggtacaaattcagtgtttcagctatgcaatcttgagcaaattaatcacacttctctgcacctcagttcacttacccaaaggctgactgttagactatctactgctcatagcgttgttttaaggaaaaaataaaataaggcctgtgtagggaaaatcatggctgaagcacagctgtgactcactgaagcctggtggctggagtcaaacccacatggttcctcttggtacttacatgaagaccctcatttacatgggagttggagatcctggaaggtatgtttatgggggaggggtaggaacaactcaaaccatgtctggaattagggtacagtggtctataggcttttctacaagccagaatgtattgaagtagagcaaaaataaaggtttcaagaaatggaccctagcaagagaatttaccaggagcaataagaactccagaatcagcaacctccagggcttgtgggaaatagtggttctgggtagggtgctggtggctggtagaacaactcattccagctcagctactctcgaactggctgtctactggggagaaaaagggctgtatggatgcctacagtgggtcttgccaaatggggccactctggggtccaagcagctgcagcgggattctccttccagagctaagcacaacatggaaggaaaaggttttctgcctgctgccttgcaagagacaggtgaactctcgtgggcttgggagtcccaacagcagtgatgagtgggataaattggcacggatcatctccttggtggctgtggtggtggcagtggtgtggcttgggggtgaccacccagtagggacatatggcagcccaggctgattcatgatcacctatcttggattcctagaactatctggatgggatttgtgtgggcatggattcatgtatgttcagcattctatgaaaattgctgatatttattttgtttatgtaaagcacttagcacagtacctgcacatggtatattttcaattagcaacagcaatttttataaatgttgggaagaaatgacactggctagatctactagacctatttagaatttttcttgagtaattctatgttgcttttgaaatgttcttaagtctgcttgggccagatgtatgtttgctacggaaccccttataaacagacatttttaacactgctaactaataggttatattaggttccaaagttggaatggtgtaggggacaatgtgggtctcagttaaaatcttgatgacccaagtaccataacatagtgttatgttgacctttgaaaaccaaaaattctaggtcatactaacttcagcccattgtgccgttattttgagattcatattgtttatattttggactgcactagtgaacccacccagcttgtaaacttgataaatgttcttttaacttggtcgttgtccaagttaactgataaaaattttgaataaacagggctgaggccagattccagagggcttcccgaagacagctccttgcaatatgttttgttccttaataaatattctttgtcggcttgcattcctccagcttcttagcatgcattagatgcaattgcacagagctgaaaaaaatagtaatgctaatagagataatagtgatgacaacccacattatagggccactcttaggctattattgtcaggcagtgggttaagtgctttatgttgtattccaagctagtattcaaatggaaaccaatcttctttaatttctaggtctctattggaacatctaataaactgttgcttttactcaaacatcacatctgcctttggggcttgaggtgtgtctctactctccttgaaagctgactgatgtattatagcgtcctctttgagcatctttgagccaagcctggatctcacatttaacttgtatttgtattaggcatggtttccatgctcatacataaagacaaatgaaggcaacttctcccttctttctgtatgttctctatataacaggaagcctggagctagggagccaggaatatcatttttcaattcattattttctactgccaatgagtatgttgtggtggatgatccacagttgaggtccagcctcattaacagtgacaataaaaaatctagtttaaaatctacgggatcctgtttggacatttatattgctaagaatggggagctaaacagcagataacctatccatagaaactagaataacagagtttcctctcctttaaagagcaaattcaattcttaaggtttctttaaaagactttcatatggtaacacttaagccagcatttgccctgttcctagtgagtcttctaaaagcatcattttgatcatgtgacagctcttctgagtccattaacttcacagtagccctaagacattttctattaagcccagattggtcagcccatctttcaagtgcttccataattgcccagacatatgcccagactttcttaaccagaatccccatgggaaggtgttaaaatctgtatttgaaacaaatcacccaaatgattcagatacgttttttaagttcttaagtctattttgacgtacactgattgctcccttttctaaacaaccgtagcatttgttacctgtactccacagagtaatactaaattgcaaatttcgttgtttcagaatcgggttataattcactgaatatcagtcatttggcgttctttttttttttttttttactcgatcctcccaataaacacgaaagatagatgtcattggccaattttataactgaagaaactgaggctcaagagtttaagtgctccactaaaatttaaacagtcagtaactgtcagaactgagatttgataatgtctctgtggcttcagagtgcacattattttcccactccactctttgtctcccccaaaggaaagcagaaaagggatattttgaagatattccaaatatatcaattattaattacaaatacatgtgcgtgcgtgtgtgtgtgtgtgtgtgtgtatcatgttcctccaaatggatttcaaatcttttgatgctagcaaatgaattttatacttgttttgtacttaggtggtgttaacaccagaagccacacgtgggtgtttagtcatgaccactgattgttcatacttgaagaaatgatgacatcattcactgagcacatactatatattaggtgctttatatgtacaattattggtttcttataacaacactgtgagaaaaacacagtccttattttacagattagaaaggagggtctttgagtggtcaaccaatttgtccagggatacacagctcaacctttctgattctgttgtgtaagccttgccatacacaagaattatcaagactgtgtatcccaatcctcttattcaacaaatgaggaaaagaaactcaaatagtgtaaataacttatgtaaggtcacagagcaagtgagaatccaatttactcagaacaataaatggcatatttactccagttaactgcattttaaacacgtttttggaaagtacaacataatttgaaattggtttccttaaaggtatttttttattttataataataactactctagcaataaagactataaatcaaaacaacttatactttcatatccatagcctgttctgggaaaaattcatttctgctgtctgtaactacaggcttataaactttaaaatcaatatgtttgaaagcttttcaactaaaaatgagagaagaaagagaggttaggttagttatcagtgaaaatataagaaaatgtaagaatttcctagaatttccctttgcatttttcaaaactcttcaaaaatttacaagggtgattttataatcatagtctttgtaatttaacgaaaagaaaacaaaggtcctcattttgctttctgctagaatataagctttcttacaagaatataagctaggaaagggcagacatttgtttactgctactttttcaatgcctagtatttagcacaaactatatagcacaaaacaacttagcacaaataaagtacttagcacaaataaagtaattacaatattgttgaataagtaaaactttgacgaagagccttttcttctgattgggtgcaagaaggagagacacaggggatttggtttttgatttcttttaacttcatatttttaatgatatactaaataaagctaaatagtggctcaaaagacagtgagactgaaataaatgaaattctatcattagggagatgaatgtcaagttgtcctgacattgtttttcaaaggaatagcttgaacttcaaagaagaaccactgtatctcttgtagattccaaacattaaataagcacttgaggcaatagtttagcagctttctcaaactggacagtatagaaagataaagacgtcggcctggttagttcttcagccctcctgagcacggaggaaatagatgagaggtaacactgttcagtgggcacttttgtactaggtccagtgttggaggttttaccatcattatttcacttaatccttacttcatttgtattcatttgtatgacataggtactattatcatttgcatcttacaagtgaggaaacgaaagctcatagagacaaactgagactcaaagtcagagctgtctgatttcaaacttttagcttttacatcagtgtttctcaaactttagccactggcacaccacctatgtggtttttaccatattgtatcatctgtagcagccatggaagtgtgctgctcagattcctgcaagaaagacagccccacctgtcatgccttcagcttctgctcctctccctgggggctcctaccaatgactgggcacgacaggagtactgggccattcattccggtccagtgtgggcctctggaacaggcaatctgtactctatgattctccattggcttggtcaggactttcttagcaccaccttcagtttgaggctttctccacccacttctccttccttctctctctttcttgctagatggtcagaactctctgtagtctgaaggctctctgtacctagctctgccactcctacttctccttcacagatgtcttcctccaataaatctcttgcacgtcaattctgtcttggtgtctgcttcttggaggacccaaatttaccattatttatctactatcagaaccattatttatgtaatactgtctttttattagattcctttttaaacaaaatatgcttatttaaccttgagcaaaacatacgttaatctcaaatttaatgtgctaactctatttttcctaagacaccttgaatatgcatatgaatacatggtaattatttaactaaaattattcagatatgggccacttaagtcttctctcttgtctccaatatacacatatacctcacttggaaattgtttcttctattatattgctggtaaaagatattttaagataagtaatggtgggtgatgaagaaaaaggattacaacagaatgtgtcagctgacatcatccaaagtttttatgaaatagtgaagactgtgttctgggaagaacctggaaggaaggtttctgtatgacaggaagcaaacaggcaaggggccccgcatccagctggattctggacgacggagtaaagctgacaccacagtggcatctgcattcatcatctgctttgcatggtgtgccaagtgcgatagatgttttgatgaaattctgaagttagatttttccagctctatgaattccacccacaccctcatctccaacttcttgctcatcttttggccaaatttaaaacagacaaaagctctgcacatgtgtagcagctggggcttgctcagcaatgataattaaggaatagatctagaataactcagccccactctccctgtccttgcaccactcagacctcagatgggaacaaaatcagacagtggtttgacttttcctgtcatagagcacagtgtttgcctaccctggtggtgaactgatggacaccctaggtttctaaaaggatagtggagacctagtggctgataatgaatgattctgtctggctggggaggagtgaagacagacagcccctaggtagttcatcttgccagagtaagagtgctcaaagagaccaggaagaagtcagggttttaaaccatttcagaaggaaaatgaaatcatgaaataccacaaccctctgtcatgaaatgaagtcactcaaagaatgaaaaattctacttgttcatttccttttcttccccacgaaacacatgtttataacatgacaggcgtttcatttttcctaggaacacattagaaggcttctactcaatgggaagccgagtcattttgaagaagaagaaacaccttccatacattgttgagtacaacagttagcccaatagaaataagttctggagtcatccccgcccggacgactctctaacgcttgaaaatcagacttacctttttccaaaacagtttgcccagaggcagagaggtgggtcctgatttctccttggtgccttccttcgcaggttcaggggttgtcacggactgtgtgtgccccgatgggttgcatcctttggaattcttgccagccccttgggtctcctgggatgtaaagttggctttgtctgacttaaggtcagctgaagtggtgggtgacttttcagcaccctaaagagttaaaaaaaatggagggaaaacattcaaaatggtctcaaaattttaaaaatggaagatctctttttaataaacatgggctgaggttatacataatgttaattttcttctttatatttttctgtattttaaaaatttttactgtgaatgtggacttgtgttaaaatctcagaaaaagttaagatatttttctttcaaaaaataaacatagaagcattattaattatgtttatgtaagtaactcattaggaatcaaggtggtggtaagagaccctttgctgttagaatatggagttcttatttaggccactggtctccaaatggtttcaatcaagttcccatcagtaaaaacattttgaatttccaccttcaatacatgcatacttatttatgtatatattataaacatgcatcatcttactgatcaaaattagaaattaaaggagagttaaattaaatatagaacttctgaaatttttctccatactccactttggggatgactgagttagactataaagttagtaaaaggcaactaggctggaacttggtgaagggattttgaattggaagagtgtccacaaaccctatttcttcacttttaggtgcagccctacactccacaattaaaacttcttgaaatgttatccattcggtctttatttcctctcttcctctctcttccttcccttcttcccttcctccgcctccttccctctgtctttttctctctccctctgtccgtatctcctttctctctttctgtctctctctctgagcagctgcactgaagtccaattccaggacatctgatttcttcagcaagggggtgttaatttctatgctctgccacccactgagtcatgagataaaggaagagttgggagaattatagtcagaatttatcttgacatgagtgaatattggtactcataattttaacatcaggttcatctgacctaacctcttaatcctaaacatcttcattttatgattttttttgctctggatacttatgactcaatccctttaaattcccagggatgtaatatccttgaataaattttctgactaaaagaaaaaatatattgcaataaaaatggggtatgggccgggtgtggtggcccaacacttgtaatcccagcattttgggaggccgacgtgggaagatttcttgaggtcgggagttcaagaccagcctgggcaacatggtgaaaccctatctctacaaataataaaaaattagctgggcatggtggcttgcacctgtggtcccagctacttggaggctgaggcaggaggattgcttgagtccaggaggctgcagtgagccatgatcgtgccactgtactccagcctaggcaacagaacaagacaccatctcaaaaaaaatatagaatatggacaaattcagaaagtttgacagtattttttgatcctggaaagagtcttaaagcccatctgatccaatgcatgaattttcatggatggggaaactgaggccaatgatctgcccaacgctgaacaagggcacaacctggcctcaagtctgaacttctggctcctttctagagctcttcccaggcagcatattgcttctccaaaggatgtttgcaaataacatgaattttactatttgatgcaagacacaacatcttctttgctgaaatttttaatactaagaaggagtcatccattgagcagattctaagttcaagttaagataaagaactgacgtctggaaatgaattttgtgatagttgatactggaatagctccagttccatttaaaagtatacaaaatggcaaaatgttggaatttacaataacctttgcattttatagacagtgaagtcaaaatggctgagctcataagattctgcattacaaacgtcccaaacgctcttgagtacctggtgctattttagctctaaacggtaattaaattaaaggggactggttaaagggtaagtacccctcctcctaacacacacatgctaagtagcttgttttctttttcagaaaataagagaaagtattattcaataattcatttaaaatccactttgagtgtcctctatgagccatgatatgtactaagtgctggggttacatgtcctcaaggagaggatgacagtaaataattccacaaataaatgtaaaatttcaactgtaataagtgctactgagtggggaggcgatttgaggctattcctctcaatcccataaaaagctaaatcaaggagtttgatccactcatgaaaatcagggaagacttcactgagaaaaggatggttgtgctttgatctgaagggtgactgaaaattaaccagagaagggaagaagagagttttccacgcacagggaacaactgccctaaggtccttcggcaagtatcggagcaaagagtggccaagcgtggctacttcaacaacaacctctccttctgctttcctgggagaatctccatttgcccagtggtccattttagaccaagaatccaggggttggggctgacctcatccccatctctaagaaagggctctggttgctttaagccaatcatcaatctgccgaagtcattagaagggcggctccatggccccacgctattttggtgtaacttctgtggcttggctttgtaccttttctaaatgctgtgttatttttctggctcaagggttccctttgatgtgcatttagcccacttactcagagtcacatagaggttacaaaaaacaaggtccccaggtcctggagtgccagaatttacctgggacagctccagtttacctaatgcattacatacttggccgttttcaccgctcagccaccaccctttctctctctgcttagtctccctggaccactgttgcatcttgaagacataatttccaactttaaacttttatttgatgacaagaataaaaggtaacagtgacagacactgttttaagcacctgaatgtcctgacaaaagtcctatgacgaacgattattttttgtattttaaaattgatgaatcatagttttacatattttcggggggtccatgtgatattttgatgcctgtatacaaagtgcaatgattaaaccagggtaactggaatttccatcacctcaaactcttatcctttctttgtgttggaagcttacaatttttctcttctagctgttttgaaatatccaataaattactgttagctgtaatttcccaatggtactatcaaatgctacaacttacaggaagacactaatttttatgccaatttcacagacagggaaatttagttgcttggtggctaagtaacttgcccacagttacactaatgagggggcagagctgacagctgaatccagggagtctgatccccaaacccaagcattaatagtgactccatactacactgtttccaatgaatcaaggtttcctgctccctgggctattccacccatcagtgagggaaatctataccaccgttctcaacaagggcaatatacaacaaaaaataatattgcatttgttcttgggagaagggttatgccaaattagatattaacatggtctgtgtctcccctaaagaattacagtgcattaacaggtataaagaatatttgttacattaaaatttcgtggagggaagggtgattagggcaaaaaatagtctaaaaaagtatcatggtgagggctgatactgagataaagattgggaaacacatctatactgatcagtttcatagggaagtgaccaatttttttttctctttgcattgggaggatatccagaaacccttcaaaaacattacaagggcatgaccctactacagttatagtaactatataattctaatttatttgtgtagttgtttgttgaatatgtatctcttttgctagagtcttggtcatcatcatatcctaagaccaagaaagtcttggtcatgattacgtccccaattcccatcaggcctagcttctggcacaaaatagacaatcagtcattcaattaataattacagtctatgacagggaccagagacagacacccacacaagatcctgtcatgccatatttccagccacccacccctgctcactgggttgtagaataccagtcagaacaccattagtcttttcattcctgcccaccactctcctgccttcccaaagaagtcccccagatggagttctgccagcatcaaccaactggatattctttgtttgcgttacagaggagactacaaaaattttaattgtgttttcagaggcaatctcatgaatagggttgccagatttagcacatgagaataagaatatgagatattccattaaatattaatttaagatcagcaaagaataattttctagcataagcatgtcccaaatattgcatgggacatacttatatttaaattaaaaagttatttcttgtttatcaaaaatttgaatttaactgagtcctgtatattttacctggtggccctgcccatgaaattctagtggattcaatttggagattgtatgtcaaatgaccttaccttcttaataaattttcgtcttgttttcacattgggtgtgggagagaggagatgttagtaagatgtaaacactacaccaagaaccaaaaacaatgaatgaatggtagagcttataaatcatgcatgctgcttgctaatacttcagctgccttacagaaagggtgggcactggggaaacctgaggagagaggggagcattttggggcatggcaaaggcattctaaaggaatgctctgttttgtgtctaaagttgtcaccaaacagtggtggccacatgaaaaagtttgattctgagacatcacatgccattaggccgagaaaaatggttccaattcagcaaaagctgacactaaatgtatttcacttactgatttcagacttccctactttttgaactgagaaaattctttttataagaaggatcatagagatgtagagaaataaagccccagaattaaccagaattggtaactttttttttaatagcaaaatagttttatccttcaatttgcttgaatttctcgttttcttttccaggtgacaaacccatggggaaatggagagtatcacacctcctaaaatcatgataatgtcactgagagaatctggctggttatttaaaggccctactttcctatctttagagacaacagaaataatcaaaagagaaaaagaaatgaactatctcaggtgcagaggtaaaagccaatgagctctaacaaactgctgcgtaaataagaattcagaacatttgggaggtgtcccttactttgatttacacttacataaaaaaatacactgaatgccactcaaggcaaaaccctgaagtccttgtgtctgtgttacagaattccagaaggctgttcccgcggcctcttcccactcttccagaatcctgtcttttccccatctacctcagtgacaagatgggaggccaacagtttttgggaagccctaggaatgataacattgaacttgggtggtccctttattggtggcaagagatactgcagacgtaaaattttgtagtgcatgaagtgaatgtcataatgaaaggcagatctggggaaacatcatacacttcttaaactttcaaggccccttacttacaaaagctccaagtgggagttaaactagattctttcctatgagatctatgacgcgtttcaccagcagttactaagttatttcccagcagttactaagttatgtgatgttggagcacattttaatcttccctcccccgttgcaatatttatcattccccattcttttctcttcacagaacaaaattatcctgtatggaaattgaaaggtggcttcataacatagtctgcttacgcaaatacagattcagctgtgagaactttctatggagtgcttatttgcatatacaatcccgggactgtgacatccaggtagggaagtttttttaatacaggcttttgacttggtggaaaatggctgatattttaaacaaattttcaagcatgctaacccaattcagggatcctttaaactgatggtttcagacaaacactggcgtcttcttagacattggaagcataatatttcccaaactgacttcagtgttgtcctaacttcccaaggacatggagctgaaacatgctctgccttcattcattgcttttttccgcctggacttttatttgggttcagtgtaagcttagttaatattggaaatagatgaaacagaccacagaaagataacattattacttgaggttagaagagtatttcccaaaatgtaggaagcataccattggtggatcagagaagattatagattgtgcagaaatatgatattacatagtattcaaatagtgaaaccacttctccttttccaactctcatttaatccttctactaacattctggagaaagtctcagtctggtgatggtacatctttaacatttttctaccattggccaattaatcaccttttaataaagctagaaagagcatcagattcagagcttaatacaaatgaggtagctagaatgtaatgtctttttaattagccaaattaatgcttaccttcctcttaggaaaaattattctgattttctatatatgatataaagtttcttttaaagatacaatttaaatagaaaataggtcaatttcaatgtaaaaatatcaaataatagtacatctaacaaaaatggtgaaggtggtacacaagttattgacatttgggaaatactgggttagaagaatagttccagaaccctggtccgcactaggaagacacctgtttgaaatgtttatgactatggggacttaaaaatcactgaagtttaattcatatcatctttaattctcttttaatgatccccaccacccaaggctctgtttttactggagaggagctgggtgggctcaggatggcacatgtcttgtgaagaccagagttcttgtttttcctcctactttaataagatacagaccttatgcctaaagaattttctaaaggcgagtcctagcctggggctatccaggtgctttttcttggtgcctctagcctggatctcggatgtcttctgaccagcttgtccatcacagacactttctgctttcgatgcctttggggcaacagcagtcacaacctcagaactttgtttttgaacaaaattctttttgttttctgttgttttaaagtgcattaatacgctgtgacaattaactgttggtacaccatcccctcttctaaccacaaaacaccctgtaaatgtttatcttttttaaacttccatattcacaattttagatatacagtgattttcaacagtgacctatttaaatgacccagatgaacacacctcaaagcaagacagaacaaaacaaaactctgtatctccatttgctgaagacaaataacaggagaagataatgcagtctctacttgatagttgtagatatctaaatgctattgctacatggtaaagtaaaaaatacctgcagacaaaatatttctttttcatcctggagtcaaagcaaagactgctgctgaatgtcttttagtctcaaatcgatctcctttgattcactattagaaactttatggaagcaatatcacctgcaaaaatttcaattcacttctagatgggtagacccccgccaggcagagaaaatgtgtagtgtgaaccaatccactgaggcaaagtagagggagatcgaaaccgaaatagcctggctacaaccactcaagattgttggctcaagttacaaatgtcagggactttcgtgtagggaaggtagtgggctgaaaacaatacagacttcaaaagcatgaatccaagaacttcagtagaaaagatatcaaaattgcaaggtatgagaaccaggtttgtagaaaacacatctgtttgtgggtgtcatggacaacctacattcacaaaacccgcttttgagacccagctccactaatgtgaccccacagcttcctgggcaggacggtgagattttatcagctgggtacgttcagttttgaccacattctgggtcagggaggagtcttggtccatgaccagctaaagagaatgagtgcatcaggtcacttgggaagccacacacacattcccatactccactgtttagagccttttacgctatgtggcttcaaacaacgcaagacatagaaccaaaagaaatacgttttgccccaaccattcattgaacttgaccctatgacctcggagcaaatgaataactttataggaaaatgcatgtagatgcttcagatacatatttttttccaatggaagaagaaaattctcgaggaaaccaagaaatacaatacaaatgtagtcatgtcattcaaccaatcttggctgtgatcattgaaatagggatcgctacatttaatcagagctctacagtttgcaaaacaatgccacaccttcattcaaccttggggtccaggacaaagaatttttttgtcccaattttatagacatgaagacttgggttcagacagattaagattgtaccactatcaagtagcagaactggagctgaaatgcaggtcttttgagacaaaatctaggatcctcttttcacagccagctccttcacatgtgggtagcagatgtagggggcaaaccaagccatgtatctgatcccactgtttttcaaagcactttccgatatcagaagaaggacccaagacacttatctgtcaccaagttaaacttccttcatggttcccgtgaaacttaaaccgtgtattccactagaggtaacgagccttgtccagtgtaaagggagaacatctctaggaagatggtatttcaaaccaagtttattttgaggagagtgggctgaattcttggatgacagtgaagaacctaggctctctagcgtgtcctaacgcctctgcatggccatccgtttggcaggtgccccagggaaactattctatttcaccaaaccactgcctttgcagtaaagatttatttagttttcaaattacattgaaaaataacatattttttagaaaacaaaaatatagcagctttcttctactttatttttttagagtccacgtcctactgaaaagctttcttctactttacatggactgttttttactatattccctgggtccctctacgcacaactaaaaagactaagatgatgatataattattagtattctgttcttatgctatataagaaattggtattgtgatattatttagccagagttggcacgtctttcaagctttccagtaaaattttaatttaactactgttaatgtaaataaaatattttaatgacaacctaacagcactattaaattgctaattatatatagatatgatacacacacacacacacacacacacacacatatatgtattcaaaaaacaagcaggcagacacaaatccaaatccaattctatgcgcaaacccaaatatatacatacacacttccaactacctaccgtgtcttctgggtccttttttgtttcagctttgttaggtgaaaccttaaaagtttgagaaagccaaatattagaaatcattgctctttagagtgatttttatttcatagataaataactctttagggtggtccagttcaccatacaggtcaagaataaaatgagaagtatttttagttcaatagaaatctcaggaccgccgggtaatacaaaagttaacaaaattaatatcttataatgagatacatctgatcttatacatttaccaagagtttgaccacattcaaaattgtctcctggaagaccacagacttccaataaattttaccattactccaaacacatgtgcaaccctctggtgtttgtggcacattctgttgacatttattgttttttcttttgaggttagtcttgatatttgaaaatagcccaaacacatttgggacagtctgcttcactatgcattcattcattcaggtttttttttttttgaatgatttctacagtattttatttgccacttgagtggcaaaactgctttgagatgtccacaacacagggagatatttttcaattatttttatgatcaatgaacataagacattcaattgcaatagaattccattacaacacagcccatgttacatgatttgggcatccactgcttataccatggttccgagcttcaggggctctcttgctaaaagtctgatataacacaactttcttatgaagcatatcttgtccctgttctctcccatgctccaacagcaccatgataattcatttagtacaataacattcaaatgtgcattattcttagaattaacaaaacttttgagcaatagagtggaggggaaaagaggagaaaactgcttaccagagttttaaagaaactcatgatggaattattattctctgctatagctgctgcctgggaatcgtcctttgcagtctccagtccttctgggtccccagggacagagcaatccgcagttccaagttcttgtccttctttttccttgccgtcaactatgtcctaggggcaaaacagttgtcacagttgccacttgctgaatgtgaactctcaaagtcatacttttgcttcacacccctttctctcttaccccctaattccagccatacttcttctgcccacaggcgtgcagaacaatcatgagattataagagtcactcttccttccctccccctctttctaacatattcagcatttgctgttggttggagggacattgtttggagccaaagggtaacaaacacagcagtgcacgttgcatttcaaacaaaaacccttttcttccaattctgcaaagaagttgtgtaaggtatcgatattttccatctttatagtctccttatctatgatgtgtacattatccccagagatggcgtttcccacaatttccacagagttggattatatcaactaaaaaaaaaaaaaaaaaaaaagaaaaagaaaaagaaaaagtactggtgtttaaaaataactattttgcttttgagatatgaggttcatctgtgcaaggggtgtgataggggaactgattttctccccgacctcctcaggagggtaggatgcgttctgaatctgccttcctttcaccatctcacctctcacgaccccaggacaggaagctactgcctctccaccttctgactgcaacagccctggccttgtctctggttgggctcttgaccctcacaatacattctttactcaacagatcccatcttcccactccttaccaccctccagtagcttctgacagctcttggagtcaagcccaaactctgatgcaggatctccaacgtctaacatggtctgcccctgcctaaatctccatcctctctgtaccacgtgctccttcattccattttctggcccactttctttgagtttttcaaacataccacaggttatttccaaacttctggctctctgtttgaaacattctgctcctctgtctgcccgtaggtaatttccatccatccttaaggtcataagtgtcatctctttggagagattgtccctaaacattcatctaaggctgtcctcccaccactgtcgtctccaccagagtcccttgcccttttaaaaatctttgctgtgtcagcagttctgtttacttctcagtctttgtgcttttcctcatactcccattagactacaaactcgacaaagacagggataatatctacttcactcagtgcttttctcaagtaccaaggacagcgaggcccacagaaggcattcaataaatatgtatcatttatgaaaattttacaaacatagaatagtgctatctgtaccagcataaattctcatgtgacaaagtagtacagaaacttcccattgcaacacagctaaacctgcctcattctttacgactcaggtgacatttattccattgcttggttataacattgtttattgtctaatatccttattgatggacattcacagtgtgtatagttgtacatctagagtattataagcagtagtaaagtgatcatctcacacttttatttttaaatactcatgtatctatattttctttgggtaaattatcaaaaatgaaatttttgggtcaagaggtatgcaaattatataaacttgatgaatattcttgcaaaaaatgagaaggtttcaacagagaggtcctgcaggtacatcggtgcatctgagaagctgtttggtgcaccggaggttgtgacaagtgagacctaaaacgtatccgggctgggcaggttggtgcatgtggttgtggcctggcagtggggagcttggtctggaggtgggtggagtgagggaggcggactcgactctcacctgctggttgagcatcgtcttcactcttcgccctccctttcatccccgtgtagtccttcctttcatcccagggctgtgggttccgccttctccacaccatctccctgcccccatgctgccagttcccttacttagaggagaatgaaaggagacacttctgtttcctcaaaagcgatttctaacaattcgcagtgtgtgaggtggcagaagcccacagaagacttggtatttctattttgaccccttctctcagtagtggagagtgggatatggtggcactgcatttagactcctggattttatactttctcctctggggttggcagtgtctggacaagcagtataaattgatatgggttgactatcccaaccactgagatacaattcaactcattttaatggacgattgtattgggccattttttgcgttgttataaagacatacctgattctgggtaatttataaagaaaagaggtttcattggctcacagttctgcagcctttacaggaagcatgggactggcatctgcttggcttctgggaggcctcaggaagcttacaatcatggcggaaggagaagtgggagcaggcacagcacatggtcagagcaggagcaagagagaaagagtggagggggtggtgggacaaacttgcaaatgaccatatcatgtgtgaacatagagcaagagctcagttaccaccaaggagatggcccaagccattcatgatggatccacccctgtgatctttcaccaggccaaacctccagcataggggattacaattcaacatgagatttaggtaaggacagatgtgcaaattacgtcaactacttattaagcattacatgtacaccagtgctttctctttcctaagctagtataatttgaacaaggtcgcttaatcttaatatattattatttattatagaataatatacaatgccaatacgtcaaatattttacatttacagcatgcaaaccactatacaaataaatgcattaaacatatgtcacttaatctttacaacaatcttctgagacaaatattacaattaacagtttcaaacaatgaaatgaggctcagagagtttaggttacttgtctaaggtcacacagcttgagagaggccaatatggggattataagtcaggcctgtcagaactgaacatcttaaaattctatagattatttggctatgagtgtcaactttgctaaacttatatagtgtgtgcagtaaaatgtaacatcatataaattaaatccaggtggtggaaaaccaagatcctcatagggagtgtatataaatatagactacatccataaattccaccagtaaaaacccttcataacttaactctcccaaaaagtactgcacttataacttgtttaaaccatgtcatccttacgtcttaaacaatgcttgtttatgcttgtatagctttacagttacgaggtgccttcacaaatctatcttatctaatctttgccaagattgtgcaaggcaaattacagatgagaaaactgaggcccaaagaggtttaaacatcatgtccaaggccacagttggcaagcgtaagcattaatttgtttttgcctaagtagcattcctcactccttgtgacaacaggaccctcctgctcattcctggagaagtgcccctcttccattccattctcattgctttcctgcccgtttttttttgttttattttccccctgggtcactcttttgtaaccccagtgacctgcttgctcttctttgaacatgtcaagtaggctgttgcctcaggacctttgcatctgggctgagcttctgcctgccaggagcatgtgaccttacttctttcaagtctttttcaattgtcacttttttctttttttttgagacagagtctcactctgtcacccaggctggagtgcagtggcatgatcttgactcactgcaacctctgtctccctggctcaagccattttcctgcctcagcctcccaagtagctgggattacagtgtgtgccaccatgcctgtctaatttttgtattttcagtagagatggggtttcaccgtgttggccaggctggtcttgaactcctgacctcaggtaatcccctcacctcggcctcccaaagtgctaggattacaggcatgagccactgcgcctgagccaatggccacgttttcatcgaggtctttctttaccactctactttaagttgctataatatatcccggcatatctgatgctgctaattgctttatttttctcctagtagatttcacttctaatatattactggctcctcttccccctaaggacatctggtaatgtctggagacatttttttgattgtcacgagtagcgggttagtgatttaccactggtatctggaggatagatgccaggcatgctgctaaaattcctgcaatgcccaggacaaagagttatctggctctcagtggcaagactgagaattatattaaaactctcacttgtcattttgtgttttgttcctctcccttcactggaatagaaaccaatgaaggttctttttctcccttatgtttccccagcacccagacttgtgcacatggtacaatctcaaaaattactagtgaatgaatgaacaaatgatttaatccaagtgagagtatcagtcatcaatttttagccattatgatttcaaatattttttcttctctccttttctctcctttcatggactccaattacctgcctactagcctacttgaagttatcctgtagctcattaatgttcctttcttccttctttttgaaaaagccctcttccttttcacccactgccctgtggttccttttggatagtttctattgctgtgtatttaaattcacaatttttttttctgcattgtctaatctgttgttaatgtcatccagtgtattttttacctcacacactgtagtttttatctctagaaatttgatttggattttaaaaatatatcttctatgtctctacttaactttccaaacatatgagacacatttatgctaatcctttttatttttttgccaattctaacacctgtgtcagttctgggtaggttttggttgatttctcttcacatcatgagttacattttcctgcttctttgcttccctggtaatttttgtttgcatgtcagacattgtgaatcttacctgtttgggtggctggatattttttgttcctataaatatttttgaactttgtttttggaggtagttaagatacttaaaatcagtttgatccttttagttctggcttttaagatttgttcgtgaaactgactttgcaaaaattatgagtgaaaaaattatgactgtgaaagagatctgacctaaccaacaccatcttgcctttaacttccaagctgcccttgttcattcctgggggtaggccacactaacttcgggaggaatttagttatagtttaactttgaaacaaagataataacagtcccttccccaaacaagccccctttattcttggggaccagtccacctttgtaaaactagcaaattagacacaacattagaaattatggctcaggagtcatacagccagaggccacaagattcttcacctccccagttgttcttatggataacattactgctgtaaaacctaatattggtgtttgagatatttttcagaccctgcattctggtctggctcatctggacttgcggcccccacccaagaactgactcagtacaagaggacatctctgatgtcctatgattctgcccccaatcaactaatcagcattctccacgccttagcaatctgcccaccaaactgaccttaaaaaactctagcctctgaattttggggggaagctgatttgagtaataaaaaagttctaatctcacatttaattggctctatgtgtagtaaactctttctctattgccattcccctgtcttgataaattggctctgtctgggcagcgggcaaaaataacccattggcagttacattaggtaggaccaaaatcgtgtctagtctaggaagctaatattttctcgctaatgaggaaagaccctgtgactactctacccagtgccttattaataatgaggttttctagtctggctggtgagagaaggcactctctctggccctgtgtaaatgcctttctggtggttggttttttttttttcccccttcagtctttgctagtttcctcatatgaacatattggtcagctctctgcctcatactatgtgaggacctttgacagacccttggagtttgctctctgtgtatctctctctctcctctgatgctttgtctatgaactctggccaccttgggctcagggagcctgctgggctctgcctcagttcctcccccctaggctatgggctggaaaccctctcaaggcagtaggtaggagcagacacagggattatctcttatgtcccgtctctcagagaacacctatccttgttgcctgatatcttaaaacagtcttaaaaattgttgtttggtttttttgtccaagttttcatctgttttaggcaagagggcaaagccagttcctgtaactctcccttagctgaaagcttctactctgttaatagtagagagtgttgacttcctgtagctggctacaggtgagttcgtttttggtgatgcatgaatcttgagctacattatcatgtgaacagcaatgaggatcaaatcaggtctgaaaagaagtgagctccctaaatttgaaattaataagtgtatttgaaatatgaactttgtcaccaaaattaataataaatcttgttctaggggtgtagcagatctttttatattaattagtgataatgattatgaacattatttataaatgaataaatgaagggaagaatgaatgtcaatgatcaatctctctttctttcccatagactgatattcaattgagtaattttgcaaacaagaattgaagctcattatctcttactgctatttgttttcctaattcccctctcatcagtacccatcatactgaatcataattgattaattgccagtatcacctgctcaactgggcatttgaggacaggcactgcgtgtgtctcattcacaacaagatcaagtggttgataaaagttccagtgcctgacaaagactccatattcacctcccagctccactcacaggttgaggaaccccagctggggtcttagcctctctgagacaaggtcgtctcatggaacacaagattaataataaaccttgcctggtataattcgttgtgagtttccataagaaataatgcatgtaaattccttagcataatgcctagtatagaagtgtccaataaatgttagccaaacagacaaaaaaaaaaaaaaaaaaaagcaatgaaaatgccatacaatttgcaaagttcctgacacagagtagattcaggagaaacatttgttaaaggatgaaaggatatggagtaaattcttttttctatgcctttgtacactgtgctctccagcttctgtcttcccttttgaaatctattcttcacgattggaatcaagtctccctctcccaccgacgtttttctgggtcaggccacccatggactctgtccccttctctgaatttctataccacagttctcagcactcagttggtacttagattatgcacttagaccagcctaacaccaaaggccaggttggaatagtttgcattaaaaatggggcttttgtgaaatggctgcaaaaatacaaaaagcacattttggtgagtattttaaaagtaacaataatacacatattctacaagggtttcaatcagccccaggactctttctaaatggaagcatatttcttgtgaaatgcctcatgagcagctgaagcttcataaaactaaaagcaaataaaagccatggtcttaatagtcttgttaggttttctggttaattctgggagaaaagtgttttgctttggaagagatgtactttttaaaaacaggttctaatatgagttgaacttttaaaaactaactctgaggtataactgggatccaagcggttaagctggttgattagaaggatggctgcaaattctatttatagcagatgagtgttgatatacgtatgaggaaggcgattttattttaggtggtatgtccgcgcacacacacagttattcttttaatgtgtattgtggactgaaagtttgtgtctccccaaaattcatgtgttcaaatcctaacttctgatgtgatggtattaggaggtggggccttggggagatgactaggtcatggggtggagcccccatgaataggattagtgctcttataaaagagaccccagcgagcgttctagtcctctttccatcattccagggtgcaatgagaagctggccatctgcaacccagaagagggtcctcacaagaacccaaccatgctggcatcttgatttcagacttatagcctccaaaactgtgagatatcaatttctgttgtttataagccatccagtctatggtactttgatagcagcctgaactaagacaatgtgcactagaaaaatatgtccagcatcaaccttttcatattatggatatttttgtgtaggtgaagttcaatataaagtaaactttaaataaagctattacatgaataactgaacaggtgtcttgaagatgagtcattatgaaagtggcacaagacataaatctagactgagaaattccccacaggcctaagtaaggtgttgcccaggagcaccattcatgaattcatcctcactcagtaactatgtgggggtagttacattacatacaagctgtgcagaggccacacagcattagcatgggctctgaagttatgctttcactgtgtattgtggacttaaagtttgtgtctccccaaatcctaaccctcaatgtgactacatacaagctgtgcagaggccagctgcccaggtccaatccctgctctgccatctacacctctgcagtactgcactttccctaactctaggttgcaatttgctcatttgtaaaagtggggtgatgagtagcacctgccttttagggttgttgagggagtaaatgggataatccatataaaggacttaggagaatgtgcagtacagaggaagcattcagtaatggttagctattattattgtgtttaatttaattactgagcactgtggtaagctgtgagatttacaaaaatgaatctgacactgtcttctctcctagatgcttggagccttatggtggataaaggtcagtagatagggacaagtactctgataaaaagacaagtgaggctaagcacagtggctcacatctgtaatcccagcaatttgggaggtcaatgcaggagaattgcttgaacacaggagttcaagaccagcctgggcaatatagtgagaccttgtctctatgaaacaaagcaaaaacaaaacaaaacaaaacaaaacaaaacagaaattagccaggcatggtggcatgcacctgtggtcctagctacttgggaggctgaggcaggagaattgcttgagccagggaggtcaaggctgcagtgagctatgattgtgccattgcactccagcctgggtgacagagcaagaccctgtctcaagataaaaagaaaaaaaagacaagttaatttcatcagcccagtgggtctcagcataactggattttagaatcacctgggcagctttttaaacaaatgccaatacccagattccaccccgaccaattacattagtctttttggaggcgaggctcagatgtcaatatttttagacctccccaggtgattccagtgtgcaccaaggtcaagagtgactgaactagaagggagagggagacttgaagatgaagcagcatttccccaaggccatggagcataggttgcaagtagactcgcagaaacagggaggaatgcgggatggtgatggagaaatttctgtcaagtggacatggaggaaggcatgtgagaaatgcagaaaaagatgaggtggggatgggtttggggagggtttagggggcaggttattcagttcagcagaggtatgggggttatgaaaagcaagatggttataacaataatttggagtcagactgaggaagtgttgactgacatttaaggagtaggtgccatggaaggtgtttgggctcaggcagcctcactctaccttaccaggatggtgggcacagggcaaaggggctaaacagcagcagaagcagcagagggttccatcacataattttgaagtggagaagtccccacctattccctgaagagaaacatcatgtggatgcccacaacggagaagatatggagagtcagagagaacaatctgcaaggcaaaaagcctagagccctttccccttaacccctcctccctaaactcacatgcactaggggaggacgagaagaggaaaaaaagcaagtcccccttcttccagactgcaaggacctcaggccatggtcaaggcagagcttggttctagcaggaattgggatgaatgttataatgaatgtgtgattaaagttttaaagttggattgggctgggcatggtggctcacgcctgtaatcctagcactttgggagaccgaggcaggcagatcacccgaggtcaggtgttcaagaccagcctggccaacatggtgaaaccccgcctctattaaaaatacaaaaattagctaggcgtggtggtgcatgcctgtaatcccagctacggtggaggctgaggcaggagaattgtttgaacccaggaggtggaggttgcagtgagccaagatcgcaccactgcactccagcctgggcgacagagtgagactccatctcaaaaaaaaaaaaaaaaaagttggattgaacaggacttttgaatcacagcaagtctggggacttgcctacggtgtcatgaaagattaggagagaaatttttgatcaaatatctactgtgtgcttcccactgatggaggcagtgagagtacagctcacagtccttggggagctgaaattctcacaagggaaaaaaccgaagtggacaaaaacacagataaactaatacatctcacagatgactcaggtggtgagggctgctaaggagaaaagaaaaggcaaggccacggagggtgaggtgatgggctgctggctacttagacagtaggcaaggttctctgaagttggcgtggaggcaaggaggtagctcttctgatccccagcctgggtccactgctctgagctactccggtctgacagcccacgtgctccccagtgctcatcacagaaaataaaaggggctatgtctaggttgcccgcagctcctgtcctgattgggtttcctaaagggctgcaaggcaatgattcttttttgtggttccagggctagacatacaggggatatctattgaactttctcaaaacaaaatggaatacagtgatgtcagctgaagggactaggaattactaaaatatcaagtggaccctatggatctaggtggccatcaggatctgccatgatggacgccctctgaatgaggaagaaagctgtgagtacttccgtaacctggagaaagaaccctactggagcagacacagttcaaaagaactccaggaacacaggagcccgctgcctttctgcattgccccatgacatcttctctagcctctctgcttccctgatttcccaactgcagtaatgtctcctgccttggacagacagtagctatggaggagcaagatctgccggcccagggcaaggagtaggtttgcctgtggctcttcctgagtgagagttttatggcctttccaggtgaaattctcagcttgaacttaagcccttactttgaaatattttttttttcttcttagattgacattaaaaaataacataagacttctgcttctgggaagatggggcacacacactttctcctgttcctctcaccaaggacaatgaagaaccctggacattatagagaaaacatacataaaaggattctgaaaggtggagaagagaaggcagaccagctgaggacccgaggaaaaacacgatggtgaattccttgggttttctttttgcctcaagtaccccagacttggagttgaagaaattagcaacctggaaacacctataggctctgacatactcacaaatcctttccgaaagcctactctctctgactaaaggaccaggaaagggcaatctggcaagacagaaaacttttagacaatgaccatactactccagccaaataccacaggacattctgtggtctcaccatctcccatgccagagaaagccaagtggggagcctagacttccactttcacaagaccgtaataggttatcccaatacccctgcaagatggcatctgtggggctaagtagggagctgggattctcatcctcaccggttggtaataagccctccccaccatggtgtccgcggggaccacatggggagcctggacttccaaccccacccaggagcaatgagatgctcctccctctccccactggggtggtgtgagaagagacccagtggagttagcgtcagccagtggtaatgagacctccactgtggtatcagtgaaggtcatgtgagcagaaaactcccgcctccacccagtagtaataaggagtatacccccgccccccaacaatggaggctggtgagaaacctggatgtttgcctccacctgacagtaatgaggtagcagccccagtactgctggaatggtgtccgggacagccagctaaaatagaaagtttaagcaagatgcagtctcataatatgaaaatggtcagatttcaattgaagataacttgtcataccataccaagaactaagaaggcctcaaacataataaaacaaggcaatcaacagatgtcaacctggaaatgagatgacagagatgctagaattatctaacaaagatttttttttttttttgagacggagtcttgctctgtcacccaggctggagtgtaatggcacaatggcacaatcttggctcactgcagcctctgcctaccgggttcaagcaattctcctgcctcagcctcctgagcaactggtattacaggtgtgcaccaccacgcccagctaatttttgcatttttagtagagatgggtttcaccatgttggccaggctggtctcaaattcctaaactcaagtgatctgcccgccttggcctcccaaagttctgggattacaggcgtgagccactgtgcccggcctctgacaaagattttaaagtagtcacaataaaatgcttcaattaacaattgtaacagtgcttgaaacaaatgaaaaaatagaaagccccagcaaagaaatagaagatataaaaataactaaaatggaaattttagaattgaaaggtataataatgaaaacaaaaagcccagtgagtgaaatcaacagcataatgggagagacagagagaagcagcagcaaaaacctctattagtagagacaacagatgacaacaaaaaagagagagcaagagagtcaaggtacagattaccagtatcaggtacaaaactggataggagaatgccataaccaatgctacctacataaatttgataacgggcaaaatggaacatttgctcaaaaaacacaaactattataactgacccaatataatataaatgatttaaatatccatataactattaagaaaattgaattcataatttaaaaacttccaggaaagaagtcttcaggcccagaagacttcactggagaattctatgaaatgtttaaagaagaattacaccaattctacatgaaatctcctagaaaacagaagagggaatgcttactaatttattttataaagatagttaccaaaaacttggtaccagaaacagataaagatggcaccaaagaaatgaaaaataccctactgatcaatatgcctcatgagtatagatgcaaacattctttacaaaatattagcaggtagatttcagcaatatgtcaaaagaagtatacatcataaccaaatgggatttactataggtttgcaagcttgattaatatttgaaagtcaattgatgttatccacaatagtgacagactaaagaagaaaaatcacatgatcacaacagtgaatgcagaaaaagtattcaacaaaattcaatcctccattcatgataaatctctaaggaagacagtaacagagggtgcttcctcaacttgataaagacgatctacaaaataaaaattgagaactaacattatccttaattctgaaagactgaatgcatttctcctaagattaggagcaaggcaaggatgtcagctctcattatttgtattctacatagtagtggaagttctaggaagtatattaaggcaagaaaataaatatagggaatacacattgaaaaggaagaaataaaactgtccccagagaagatggcaaaattagacaatttcattattttcaaaattagaaaatcccaaggaatcaacagaataacacctagaattaataattgagttcagcaaggctgaagaatacaagataaacatgtaaaaatgatctagatttctatatactaggaatgaacccatgggcactgaaattaaaaatacaataccataataatcatacgaaaatgaaatactaaggtttacatctcacaaaacatgtgcaaaacttgtatgctgaaagctatataatgctaatgaaagaaatcataggagacctaaataaatggagagacacacaatgttcatggattggaagactcacatagtaaagatgtcaatctgccccaaattgatatacaggtttaatgcaattcctgtcaaaattccagcacttgtagcaagacattttgtagagatagatgaggttattctaacatttatatggaaagacaaaggatttagaataattttttaaaatataaattgatgaatcagtctatctgatcacaagccttgttatatagctacagtaagcaaggctgtatggtattggtggagacatagacatatagaaccaatggaatagagaagccagaaaagacccacacaagtatgcccagacgacttttgacaaaggtgtaaaagcaattctacagaataaagatagtcttttcaacaaattgtgctagagcaatttgacatctatagaggaaaagaaagaacctcaatttaagtctcacatcttatataaaaattatctcaaaagagatcgtggacttaaacataaaacctcaaatataaaacttttaggaaaaaaataagagaaaatttctgagacctatggttaaaaaaatccataaaagaccaaagaccaaaagcaaaatccataaaaagaaaacataataaattggaattcatcaaaactaaaaaattttgccctgtaaaagatcctgttaaaaagatgaaaagagaaactagagagtgggagaaaatatttgcaaaccacgtatctgacgagagactagtatttagaatacatttaaaagaaaaaaattcttaaaactcaacattaaaaacaaacaaaacaatccaattagaaaatgggcaaaagacgtgagggggcatttcattgcagaggatatgcagatggcaaataagcacataaagatgttcaatctcattaaccattagaaaagtgcaaattaaaaccataacgagacatcactatgcacccatcaaagtggttaaagcaaaaaatagtgactattaaatgctgggaaggatgcaagaaactcgattactcactttacaatgtaatcactttacattgctggtagaaatgtaaagggatacaggcagaatagaaaacagttagacagtttcttaaataattaaacatgcaggcagggcgtggtggcaagtgtctgtaatcccagctactctgggggctgagacgggaagatcacttgaccctgggtggctgagccaagatggcaccactgcacttgcctgggcaacagagcaagatccaatctcaaaaacttaaaataaataaataaataaaacatgcaactatagtgattgcactcctggtcatttctcctagagaaatgaagaattatattcacacaaaaacctatgcattaatgtttatagcaaagttatttacaatagcctcaaagttggaacaaccaaacatcaaactggtacttccacagcatgggatactacttggcagtcgaaaaggaccaatatctaccaagacactcagtgattcggattaatttccagagatttatgctgaaggggaaaaaagcctatgtaaaaaagggtacccactgtatgatactatttagatagcattcttgaaataataaagctatagcaatggagaacagactagtggttgcaggaggtaagaaaaggatgggggtgagagggaagtggatgcacctgaacagtcagtatgcagtatccttgtggggataaaaatgttctctatttgattgtatcattgtcaatatcctggttgtgatattgcactacaggtctgaagatgttaccgttgagtgacgctggataaagggataactgttgtatttcttacagctgcatgtgaatctacaataatttcaaagttaaaaagtaaaaaaaaaaaaaaaaagcttgataggataattctggaagagcaacaatgaagaaccacttaaaaagttgaacttttgggatctgcagttaaataaattcgcatgtggttttaacatgtgaaattaacccataacaatgtgtgatggaatattttgcagccatgaattatttaaggagtgtgtaatgacaaaataagtgtccatgataaccgtaaaaatgatcagcctttatgtgtcaggcccagtgctaagcttgttaaaaagatcccgtttaattcttacaacgatcccatgaagcatgcactgtttgtaattccaattatacagatgaagaaattaatgcacagaaagaataaataacttgcctaaggtcataaagtagagttgggatttgatcccaggcccagctgatttcagaggccaaaggtttttcagtgctgtgctgcactgattctatctcctttccttcagatgtttactcaaatattatcttctcagcaagtcctttcctattttaagttcctgccactttattccttttctctgctgtatatttttctactttgtaaccatcagccatacaacatatgttaccatcaaccatacaacatatgttagcatcaggcatacatgcatacgttgtatggctgatgataacaaggtggtaaaattccaaagacatataggaatttagtatatgataaagatgatacctaaaatctatggaagtgaagaacttttaaataaaagatgtaggaaaaacagagcagccatctggaaaaaaattaacttggtgtcacaactcaaccctctaccaggataaaatccaaatagattaaaaataatacaaggaaacatggaaaacagcttttcattttggattgagaaggcttttgtgtgtatgactagaaatccagaagtcatgaaaaggaagattgaaaagtaaaaaaatccaaatgtttacaaaaacattcattggccaagcttgtgtgaagaaggcaatcatgcattgctgttacaagtataaactaattcaatcctgatggagggcagagtggcattgtgtaccaaaactgtaaaaaggatatattcttttaccctgtatttccatctctaagagttgatgtagaggataaacctaaactcacacgtgtgaaataacaaatgtacaaggttattcattgcagtgaggttaatagcgaaagtctggaagccagccaatgggcattaaatggggtcctggttaaataactcatggtacaaccattcaacagaatactctgcaggcattacaagtgaggaagctccctacagatacagaaagtattgttaactgaaaacaagcgtggaatagaacagagtgcatattatgttaccgtttgtgtaaaaaagaaagaaaaagaatttatgttttatttcttatatatgctcaaaggaaccctagaaagatacattaaaaatacaaacagcaattatctactgggtggcattttataattttttgttttgaacagagtgaatatgttacgtattaaaattaagactaaagcaaaatatgcatgattaactaaaaaaatttaaaaacatcaagagggccaagctaagcacagttgtgatgagagtccagccttcaggccaccagtgtgtggcctgtgctttaaacatgttatttgtaggtgctgctgctattctcatcaggcctccgaatcattctcagcaaacaacattatacggaaacagaaacattctccagaaaatacctggaaactgtttttaagcaaacaggcgtccgtggtgttagcttgtttttcacctctgtgtgagaagtttatatatattttcttttttgttggcttcaaagagcaaacagataggaacactgctaaagtgattacaatttgtcatgttgaaaaataatgccgccttatcataatttgattgtctgtaataaggcccatatggaacttctggcactttctttcaactattgtcagctggacttcagactcctttaagcagatctacattgttaaagtgaaaatataagataaggcttaaaaagccttgtctggaatgatctgtgatgcctctactccatctagatttcctcattgtgtagcactgattttactcttagtcttaacaccacgaatcagtactgaaagtacaggtgaacacaagaaaatttgtgtgaaaaatgttgaatggtacagaaactcatgactccactcctttccatctgtcagaaatttgagccccatgctgcctgggataaaagggaaggctctgcttcctctccccagagaatatcacgcgagcacagagggttcgatttgctggacaacaatagtctctggacaatcacgaagtcttcatttttcttcttctgaaaacactgtcacctgcgtgtagccattgtcagattcaggaagaaaaatagggtttggttaatttttgaagatagaatttgtcccccaatttgcctagaaaggaaagcaaattaatatgcaagcaggaaggaatgtgaagaccaatactaaaaatattttgcagaatctcagaatttcctaagcagactatgattttttttttttttgagatgttgcccaggctggagtgcaatggtgcaatctcgtctcactgcaacctccgcctcccaggttcaagtgattctcctgcctcagcctccgagtaactgggattacaggcatgtgccaccatgcccggctaatttttgtattttcagtagagatggggtttcaccatgttggccaggctgatctcaaactcctgacctcaggtgatccaccccccttggcctcccaaagtgttgggattacaggcatgagccaccatgcccaaactctttttttttttaagtttgttttactacagtgctcaaagccactgaaggaaggtcaataaatatatattaatgtaggtaattctgtacttttattttttccactactcctacccaattcacatcaactgataaaaattcaatgagtagttttttttttataatgcattcacatctttcaagcccatggcaaaaacagggaaagaacacagacagcacaaccataggaaatccaattatgaaagggcttcaaatctgcccacttaggacaacatttctctttgtgatctcctgctggagatgattacacattagctataagtatatttaaaaagttgttattctttctgaacaatgaattgtcacataagctctgggtggcatagtttggaaattattgttagaggaaaataacctcttgttgaactgttgctagcagcctgtggcaatttctaattaacacagctcaggaatcctcagcctcttaatgcagtctagaggaggaatcgagaaattacctagatggtggcatttttttacttttagttagattggtggttcactacagtgctccttttataaaaaagagaaaatacagataacaaagaataaaacgaaatgcatcgattattctattactgaaagtcaactgctgtcaacaatttgcaattttttattccacgctgctctttgggtgggatgacagagctatggcacaggaaggcagagatcatttttacccagaggagattcttctgcatgctattttgaaatctgcttttctcatttaacattatactatcactttcttcacctgaccaattctatttttatgtcaccctcgtttacggtgtctagtgtaagggtgtgccacaatcaatatgaaagacctattggatcatttcagctttttttcttacagacaatactggaaattttttaaagccccatgcataaaatattgatcatgttctcaatacattatttttaaacattttttattgatgcataatagatgtacataattttggggtacgtgtgataatttaatacattcatgtaatttgtaaagatcaaattcgtgtacttgggatattcatcacttcaaatatttgtcttctcttcatgctaaaaacattcgacttattctattctagctagtttgaaatgtacagtaaactatagtcaccctcctgacctatcaatcaataaattcttaaatgcagatttgctcattcagaaagcatgtgtgtttgaagactttaaaattgcatactgccaaagcgccacggtggaaacaagcttcttagtggtccaggtagttgattaagaaattatctaagacttcagagggaaataaaataacatgaaaatataaaaccaagaaatctagatttccattgtcctctggcatcttttctgagatggaaattgagtctggataacacagatataaaaatgttccacttagccatttttcttcctcttttggggaagagagaggcaatgttaatttcagctgcttatactaattgaaccaagccgggttggaccaattatccagtgtgatactctctactgtaaatcacaacatcactacctgttttactaccctgtggacataacctcaggatacttaaggctcatctcacacgggggtagcagaagtctagcccagggccttagcatggtacatcatcattaatccatagttattaactgatgtggagatgttacatttgtaagattaaataaagcattgtctgttgttcacatagggggaggggggaaagaaatctatctaagaaagcaacgcacacttgcttcccatataaagctagtgtacattttctcttttctccctcagcaactcctctgcttgaggggtaagtgaatttgtcaacttgagttccaatggcaagtaaaatgtgggtagagaattaagcaataaaatgttcttctcttgtttcccttttggcagcaggctttgctttggggatagtcctaaggacacatgagttggcacactcttaagtatagttcccttatgtgtgattttttttcttttcttttttttttttttgaggtggagtctcgctctgttgcccaggctggagtgcagtggtgcgatctcggctcactgcaatctccatctcccaggttcaagcgattctcatgcctcagcttcctgagtagctgagattataggcgtgcaccaccatgcttggctaatttttgtatttttagtggagatggagtttcaccatgttggccaggctggtcttgaactcctggtctcaagtgatcctcctgcctcagcctcccaaactgctgaaattataggtgtgagccaccacgcccggccaatatgtgtgatttaaaatggaaaaatactgctgcaggcagagtgagtgaagagtgattcccagggtaagccacactgggcaaaagggatttgtggaagattcttctgttccatgattagttcctaacaagcacaaccttccagactggtgacagcatttcacatttactaaaggaaaaatacccaatgttacggaaaacaaacaaacaaaaacaaaaaacaaacaaaaaccacaccagaaaacctgcctttaaatacaaaaaactaataatccacagcctagaacacattcgtcatctatttaacaaacacttccccaaagcgagaaaacagttttgaatgctgccagaattaggttgcagactttctaagaattgtttggcccgtgcaaagaaagaaagaaaaagtcacatgctattcactgactgtttaaacacttctctgtttctgttcctcacccagttgtgattttcactctcctgtctactttctatctcaaaactctgtttatttcactcagagctctttctaaactctggaagtgtttgcttgttaattctctttcttttttaaattgttggtctctccactagaaggaaagctcccatgaagtacactgttctacctgctggggaatctaaaatcattcctggcacaaaggaaatactcatatttgttgcatgaataaatgaaagtatccacttactttttttttttttttttcgagacagagtctcgctctgtcattctcctgcctcagcctcccgagtggctgggactacaggcgcccgccaccacgcctggctaattttttgtatttttagtagagacggggtttcattgtgttagccaggatggtctcgatctcctgacctcgtgatccacttgcctcggcctcccaaagtgctgggattacaggcgtgagccaccgcgcccagcctcccaccccttttatatattgcttaacactggctgcctgattgactctcaggctggaatgacagatggtcatctaagtagcttcaaattctgataagtgctatgaaggatgaaggaagtaaagtggtccatgatgggtgtatttacttgattctcaactgtacccaagaaaaataccaatgcaagtgttatgacgaaggacaacctacatggctgcgctgctgggaatcatttggtgaactggagagtgggtgccccatcttaagggacagtcacaactcacattctgtctggaaatatagggcaaaactacccattatggggaagtctgaaatatagaattgtattgacatattattgctttaaaatatcatcaactttgttaattcaaaaatataattaattaattaaaatattatttaaaacactatgtaggccaagtaagatgcatctctggctagaggccttctacagatggctagttttcaacttctggtttatgttttttattttattttacttcttcaaacccacagccaacatcatacaacttctggtctaaatgcctagctcaacgttctctagaagaaccattccttggaaaattgagctaccttgttagaggcccaacagctacatggatgattaagtttgagaaacacttggttaaacaaagtgaaacaggcgtgcttgctgcaggacttctcagagcctttagtaggtggatgtccattgtgaatcttcagtagagactataaagcaaatagattttctgaaactattccatagcagagccctatttctaggcccatcttattggactaacgttccacagaccaacttggaaagtactatcacgctggttaacattaggtgtcaacttgattggattgaaggatgcctagatggctggtaaagtattgtttctgggtgtgtctatgagggtgttgccagaggagattaacatttgagtcagcggactgggagaagaagacccaccctcaatgtgggtgggcaccttccaatcggctggcagcatggctagaacaaagcaggtggaagaaggtgggataagctgggttgctgagtcttccagccttcatctttgtcctgtgctggatgcttcctgctcttggacgttagactccaggtactttggcctttggactcctggacttacaccagtggtttgccaggggctctcaggcctttggccacagactgacggctgcactgtcggcctccacacttttgaggcttttgaacttctgccactactggcttcctacctcctcagcttgcagacggcctatagtgtgatttcaccttgtgataatgtgaggcaattctccttaataaactccctttcacatatacgtctatcctattagttctgtccctttggagaaccctgactaatacaactaactttagaattttttaaagatataagatgtttcaaaagttttaaagtgtttcatctctttgaacctataggcacagtggttaagtgtgtgggcatcggtgaccaatttccaccctgccactttctagcactatgatttgcacaagttactttacctctccgtgacttagtaaacttgataagttatagccgttacaacttctgagggggcgagtcagatgggacaataccagagggaatgataactcaaaatttattttacaaattaattgcaaaaaacaatttactagatatttcaatggattaacgccatgacatgttaaagaccaaatttaaaataccaagtagatagtacaaatgtagacttgtactatgattctaaagtttaagtgaaatcgtatacaccacatattttgcaatgactttctatttcaacttgtgttaggcagagcagataatgacgttgcaataatacatcctaacagtctgaaaagttgaaccatgacgtgtaccacccttattcttgtcaggttcatttaacaaacattattggatgccaacatgtgccagccattgtgctaggcattgggaatactcagttgcataaaaaatggtcacgtctcttaagataactgtctcaatgtgtcgaagtggtcagataacagaacagcgttctccaaatttcagactgtgatcattagcagatttaaaaataaggtagtgggtcaaaaccagcagtaaacaaatcaaacagaatagaaaagaatacaaaatccctgcaggtgttacatgctgcaagaatagtattacttcatgaattctttgtttcatgtatgcgcatgtatatcagctcaagtaaaatctagttcttactatggggtcacagttaaattagaaaactaatgtaatggatacactcagatgaattaccataggtggatactgtagcagcttctacttgctccattcacttaatgatttccagacaatgttaggtagagaagataaatctggtttctatctgtggcatgtcctctttgctggaagagccttctttctactgaagaaactgaaaatgctggctgatagctatttgcaccttgacacagacacgtgactcaatttcaccaaagggctctgaggataaattttaggaaactcctttcttatttataggacattatgacacatacatcggaaatattacacgtccaattccaggtcactgcaatagagtcaatatcacaatagagtcacacacatttttcggtttcccagtgcacataaaagttctccactgtcctggagtctattaagtgtgcaatagcattacgtctaaaaaaaaagtacatactttaatttaaaaataccttgtctcatggtgtatatgtaccacattttctttacccagtctattgttgatgggcatttgggttgattccatgtctttgctattgtgaatagtgctgcaatggaatactatgtgtccataaaaaggaacaagatcatgtcctttgcagggatatggatggagctggaagccattatctttggcaaactaacgcaggaacagagaaccaaacaccgcatgttctcacttataagtgggagatgaacaatgagaacagatggacacaggaaggggaacaacacacactggggcctgtcgggggttgggggagggagagcatcaggaaaaatagctaatgcatgctgggcttaatacctaggtgatgggatgataggtgcagcaaaccaccatggcacacatttattttaagttctggggtacacgtgcacgtcacccgggctcctgcacatcctgcatttgtaccccagaacttaaaataaaaattacaacaaaaactttatctctaaaaaatgctgacacaaagacacaaagtgaacacaggccattggaaaaatggtgctgacagacttgcttgatgcaggattgtcacaaacctttaatgtgtaaaaatgcagcatctgtgaagcacaataaagagaggtactcctgcatacttggaatcatgttaaaaccacaagggactaagcctagggactaagcaacaatggaggacaccagtagagaaagactgaggcgggcttgtgggggctgtgaagatgttgaaccaacctgaactcccctacctctagggttctttttacatgcaagaaatagtacatcctccttgttaagtgaaccactattaattgattgttgtgtgtgtgtgtgtgtgtgtttcctgcagccaaagtaaaaatgatatattaccaacccctaaatgatacactattcaaactccatcactctgaaaagccatttgatctatttcataattactcatttctaagtttctaacaatttagaaaatatacagttttatttagcatgactactactgatggcctatattatcttctaactttacaaaaacccctagggcaggtagtagcttccttttgtggatgaaaacacaggtttttaaatgattgagtataacaggcttaggtgacagatggatctcgattccacttctgccactaattagctttgcgaccttaacgcaggtaacttaagttctccccaagttctctcctctgttcaatggcaatagaaatacctaccttgttgggtttttttaacaataaaaacagataatgtatgcaaaatgcttactgcacagcctagaaataatgaattattttaaaatggggctattattgtcatttaactcaaccacacagctatttagtggtagagtctggactcatacctaggtcacccaggctcctaacacttccacatcacctctgccactgcaaacatctcatattaagcgtttcttactgctaaatgcatcaaaatcccagtggtatagctgaggaccttgtttactccaaaacttgcataatgtaagatggattttccctttgcactgacaaagtcttttgggtggctagttctctttaccagttgaaaaggcatggccttgtggacataaggcagaaacaacacaaaataaaaaacagttaataattcacttggccttctaatgttgaaattcggtaattctttttatttgtttttatttttcacttgggattttgggtatttacaactttgcatatgctaacatctttgaatttcattgcctcaagttgtaacttcattgaacaagtttcaaataattggcaaaaatagaaacgttgactatttaagactatgggctttggagatggacaattttggctgtgccaccttttagctgtgtgtcaggagtgatatgctttctctgaactgttgacttcttcatctgtaaaatggtgaaaatacaggaattccctggtaagatttgatggctcaatgagctgatttctacaaaatgatttaatcacagaatttgacttaaaatgcgagagggattcatgctgtccgaaatcatccaagagtggagatatctggttagcttcatggagaacctggcactgaatatcaagtcaatttttgataaacagagagagaaagggacataggcagagaaaataccaggagacagatggcgtttgcacaggtcaggtgttggccatattgactggagaaatttaagggaagggtggaaaatgcagttggaaaataggcagaggaaacattgtggaaacccttaaatgtcagacaaagaaactgaggcttatgggcatggacactaacatttctattgtttcaaaaataattttacaacttttatacctttctcacccaagttaggacttgtgcctttggttatacaactcttaaattagagtcaactgtgctatctctgtgagtttgggttgaggactatggaagggaaaggcaaaaaataaaagtaaaatgtgaagtagaagacagggagaaaacccataatactggtaatagctaatttctctttttcttctttcaaaatgcaatttgtgctaagtactttatatggcctatctcatttaacttctaaaagtgtgaacaatgtgagaatgtgctagatactattattatccccattttacagatgaggaaactgaggctcaggaggtgaagtagcttgcccaagatcacacagccagtaggtgacagaggtagagaggaaacctaggctacttgactatgatgcttatgtttaattcactactaaataccatgtaggaaaggactctggagaccttagttctttaattccaattctaccactaaacagtagagacaggatgaacttgtcattcactgagatggaaaaccccgtgaattaaactggtgggcattttgtttttgtcattgttaggcgatgaatgaagagttccattctggacacattagggttgagatactcagtgagcagccaaatggggatgtagaaattcaagtagacatgtggaagaggaggcagctgagactcacgtctggacttcagggatggatcccggctagagatgtaaatttggaacttgtcaacccatagcagtatttaaacctttgggactgagggaaaccttcaaggaaataagcgtagttagagatagccaagaagtgaaccctggggaagtccaacatttagagggtgagatccagcaaaggagatgatggaagagtaccagggaggtggaaggatgttgtttcaaacagcaaggtgtggcccactcagtcactgtgtcggattcaacttgcaggtcagacctactaggacaaagatagagacctataggatttggcagccagggtgatggtagggaatttgaaacatcatggtggctgtgacaagagcctgaatggagtgtgttcaagagagaaaagaagagaagtgaaaacacagaatattgttcttattattagtagcctgagccaatctgaggaccgatgcacttatcacaatgtctcttaaaatactatgtctcttactagattatacactccttgacagacgagaaacatgatttatttttcaaatgccttgcacaaggttagtgcgaaagtaacgattgcaggatttaattacacttttaaaagaaaaaagacattcttcatcttatgaaactctgcatggcaacactttatgcgccccacacccccactcaacacaaacacaactctggaagtactgtgttgataacagaaatgtggtgggttttatttttaaccaataaaggtcaagtttgcattatgtgattttgtgtgtgtgtgtgttgaatcttttaaatgcatatcttacagctctggttcagttgttgtggggagaggaaaaaaacctcatccctgccaacacattggtttgtatgaatcacagctcagtgaaacctttcaggcatataatttatcttttctttggcctatgtagtaaacgcttcatttgttcatgaattcttgccttgttttaattatgctttgccctgaatgtagttttataaggcacaaaaataagattgtcgttctgaaaacacagaagatttgtatgtttcccccaggatgaaatggtggcatctttctcccaattcacagctctgtgggcttgtggctggaattccaatccagcagggagcaagccataaaaatggggggaagggctgctggagggaggcagtagatgcggctgagcccaaggcataattcaccctaagaattctgaatcaatacactgacatccagccatgtacaatgtggtactcccaccaagaaagccactgattgagaagttttattcatgttactttctgagggttggattgtcccattacatttatagaacaattgcttttttccccctaaatacagaactatgcagccgggagtcagaaaagaaaccttgacaatcagaaggctgttttgttgttgttgttaaaaacctttgcaggcatatgcatctgaatatccataagttcacaggctgagggagaaatggctatttcataacttttctgtgtttctcatgtacatagtacaaagtgggcactcagtatttcaaatttcaatatcactgaaaaaaatggaaatttgtcatgtaacaaaatcagatgcagacttcactggtgaatctgagggagtgaattcacttattcagaaaggaagacagttacaattcttgggtcttctgagagatcattataacttgaaaatattacacaagggctttgctatattagatacctgccatgttcctaacacaagctcccattttctgactcaaatctcattttggaacacattccactcaaattgaggttctacccctaagagttctttttcaataaagaaagctgagttaataaatcacaactccaaaacttttcctcacttttcttagactagaaatagattgagtgtgtcgaggttttatggctgagtacattggagggctggctattctatgctgaactggtttacttgattaagatggggatttggatgagtcaccggacacctgtccaaagatgagtaaaacacattccttcattgtcttcccataaataactcaatcttctcctaactgagccaatggataggctttggatgcccaagcaaaacaaacacatgactgttaaaaaatcacaacctcaaaatggccttagaagcctatgaccaataatgagaatggtttctccactcaggcgcaagtagtaaacagtttctcccatatgcaggaatattgacgactagtttaccgcctctgggcacgtaactttcaggtcctggttcatgcatttgctggaatgttccctgggccatggagcccagttctcctggcatctggcatctcccccacactctgctcccccagcacagcacttggcatcttgcattgcaattgcaggtttatttattcacttctctcactggacagcaaactccaccagggccgagactctgtgtctcgcccttcactgtggtccctgtgcctcacctgttcctagtacagtgtcacactcagtaaagagcagatgcctggtgcatttggagacttattttaaattatacggaaagttattcaaccggcttcttgaactggtgaattttggaaagtgggtgtttgaagggaaaatgtttaaactctgaaagaaatgttggaaataagctctttgaatcaaaatgtatagaaaacacaagaatgctgacagtaagagcctaaaacacatgatgactattatcttttcccaattttaactctccagagtgttcagcggtgcccagccttcataatgtaattcttcgtagcaccctggatgcattaaaaccatagattaacgtgatacttattttcattaaggaaaataatttacgtacagtgctcagagtagagcctggcacattgaacattttcaataaatgacagcaagtgtaattattagcacttcggaagtgcaaagttgcattgtattaagacaaatatatttggagctcatccaattttttcctggctctgaagtctgctagtggcacttaactttattcccaagttttgaaaaatattgttatttaaaaagtctgttaaccaaggaaatgcatgccctaaacctataatgtatcaagttttacttccttcttcttttaaggagttcttttcctgccttgaatacaaacaggctctctcaaggttaaaagcaaatgctctttttagtgtcaaaaagagcttgcctttcttcgctcaggaaaaaaagcaactgattccaggataccttctttgaaaaccaacacaaaaaaaccccccaaaaaacaaaaaaaaaacccaaaacccctagtttttacaaaggtttattactcctacttgttggaaaagaattactacataaaagagtctgcccagagctgtaaaatctccttattcaaacacacaccttagagcaaaagatggttaaatatcaattcaggctattaacagtaagggacgaaatgtgttccaacaaaactctgcatgtcaacaaactacagagactaggtaacatcttttaggaatcatttttattccactaatgccttttcctccagaatccactgatcgtaaacgcaacctgtctacttccgcctttgaaaaatggatggacaaattcatctgcatgtaactcacctcctcttttcttttacataaaacagatgccacagctgttattgttcttcacacagaagtttctacccagagaaacatcaggatgacactctgctgcaatgtgctatttgttctagaggggtcaacagcttgccaccttgcctaggcccagggtgactgcatatgtgcagtggtcttatcccattagcgcccccgagcatgcattcagaaccaagtggatacaccttggcacacttaccttccctgcagggacatcatcggactgccctgataagccaggaacctcatccaccttgtcttgatgctctgccctcttggcttcctgttggctgtcacctggcaccttttcctgtcccttgtccagcttgaagaatttgtcaaaaaagctggagtccttgggcttggagggagcttctcctcctgctccccctgtctcaggtgggagaagcgtgggatccctggcggcagagaggaccttgtcttgggccggggcgtgccctggggttttatctgtgtcctgccccggtccagctgccaccggaagtgtccagctctcacttgggtctttgttcgctggagctttattggagctgacatcaagcttcactgatccaagggatgaatctgcggcttggtctccggtacgtcctggtacaggccgagagagcatcaagaaaaaacgagatttagcagctggtgcctcgggtttggcctctttcccaagattctttccgttggcatccgcaacagcacttatctccgttgtctcgggggaagaagtggccacattatccgtcttgacacttattcccaagtcgactgtaaacacaaacataaacagtggttattcagccaagccgggaaattcaggcactaataatggactccagacattttttatacaaaagccatactgcatactggaactgtgttgttctctggtcattctgaaaggcagaagttagctctctacatctccttggaccctgcttttcttgggagaggagaaggcaaggttggtgaggagggaaagctacttaatggaaagtcactagctgccaggtgtggaatgagtgatattcaatgttaattaatcttcttttatctgtgtaagaactccgtgagcagcatattgtcatgatgtcaactgggaggcagtacagcagttaggagcttgggttctggagctagaacaaggtttctcaacctcagcactactcacatttgaagccagattattctttgttagggaggctcatcccgtgcctcataggctgattagcagcatcctggcctctgcccactagacgccggtcacatttcccagtcatggcaaccaaaaatatctctaggcattgctaaatgtcccctggaggacaaaatctcttacgtttgagaggcactgagctgaaatgtctttttgaatccagattatctaattttctgtgcctcaactttctggtaaaaggagacagataataaatctcgtaattttgttaggaagattacatgagttaatagttttaaagcaagtacaatagcacctggaatatattaagtgcttaataaatatcacaaacattagttatcattattcatgagtgagaaaactgacagtcagagaggtcagtacaccctcccctggctgcccagtaagctagtaagcagcagagtctggcttcaggcagaaatctgacttctaagttcatgcgctctctgtcttaccagggacttgtattagcatagactgttaagaatatgggaagatttttaaaatacagtactcagaaaatttctctttgaaaggctggaagagcagatatccacacaagaaggcaaattagacctcaggccagtgtggaattaaaggtgtagggttatctggtcaagactgtgtgtgtggatacaggctccaacccctccaggcaagggcactgtttccaacatccaccctttctcctttgacctctaccttgacctaaattaactataaaaggtccttcttttctaggaccctactataaatcagtgaaatattcaggaaaaaaagaacaccaagaatgttgggatcccagttaaagatcaagattctctactgataagctgtgtgatatggagtaaatcactaaagatctttgaatctcttcatttgtaaaatgggaatattggtagtcctactgcagggttgttgtaatgcttaaagaagaaaagtcatgcaaaggatctggcacaacgccttttccataataagtgcttagtaattgacagatactgtgataacttttcaggtttctctcatgcctttgacaacattgcattttgcttgctctatctgtagtcagacacttcttaatatctgtttgcaggaagacagaaaaataaagggaagaattgagatttctttgatctattcatactgctcattaatatgtagtgagaaatacatacacacacacatacacacacatgcatccattagcaattgtttttgcccaactctagtgtctcgcagtgtctagactaaacaacaaacaaaaaaggggggagagtgagctggattaagcattgaggcacagtgaagaaatggtctggggcaagcccagggatgaatgttaggggtttctcataaacctgaacctgaagaaaatcaccctgccagcatattgatcttctagctcttcttaacctttttttctgtgattcaggaattcataatgatagaaaatattatactaaagaagaaaaaaagagggagaataagtaagtgatagatggatgcatcagggtgtaaagttagcaagtaaggctgttgaagtgtcagagtgaatataaatgaattgtgggaatggtccatgccaggagaagagggtatggttgacaaaaagggaaatgctaagattcaaaacagggaagggcttttcaaaatgccaagagcaccaacttatatctttcagtttaattcctctcttccttacccactggctggaaagcaaaggagctagtggtaagtaagagtgttatagccagagaaaaagtcttcaaaaaacacaaagtactttccatggacaaccttttttattttaaagtgccaatatgttgctttgaaaaagaataaattccttacatccaggtatctggactagacttcagtgcatttagtgattatagcaaatccaaacagtagcttttgatatcagagaatgggtaaagtgtttttgacaatttctaagaacttagagttcttcggtgatacgttccatgcaactgaagctctgctctccaaatttaggtgggtacatacccaagtccatcacctggggcttctatttcctttgctcagatgctcacctcctaggtgggcacctgacataagatagactaataaaaataagtcctgtaacttttgatactcctattaaaaaagagttgcaaaccaataggaggtacacttgagaatcagcacaaatgaaagtagaacctggaaatccaggaagcagatacccaatcatgtcatttaaacatttagatccagctgtgcctgaagctgaactttagcattacataagccaataaatcactcttccccaacttacgccagttgaaattgaatacatactcagtgactttgagagaattccagggaattggtcagtccctgtttcacttgtaaatacacagcaatcaagcctaccaaatctatgattgattggggtgtctgaaagagatggagggaatggaatcaacctgaaaaacatatttcaggagttcatccctgaaaacttccccaacctagctagaggggccaacattcaaattcaggaaatgcagagaaccccagtaagatactccacaaaaagatcttccccaagacatcatcatcagattctccaaagttgaaatgtaagaaaaaatgctaaaggcaactagagtgaaaggcccggtcacctaaaaagggaagcacagacttacagtggacctctcactggtaaccctacaagccagaagagattgaggaccaatattcaacattcttaaacaaaaagaattccaacccagaattttatatctgactaaactaagcttcataagcaaaagagaaataagatcattttcagacaagcaaatgctaagggaatttgtgaccattagaccttccttgcaacagttcctaaaggaagcactaaatatggaaagaccattaccagacactacaaaacacactgaagtacacagaccagtgacattgtaaagcaactacataacaagtctgcaaaataaccagccaacatcatgatgacggtatcaaatcgacacatagcaacactaaccttaaatgtaaatggactaaatgatcccattaaaagacataaagtggcaggctggataaagaaccaagaaccattggtatactgtcttcaagagacccatctcctatgcagtgacacacataggttcaagataaagggatggggaaaaatctaccaagcaaatagaaaacagaataaaacaggggttgcaatcctagttgccgtcaaaacagactttaaaccaacaaaggttaaaagaaaaaaatatgggcattgcataaggataaagtgttaaattaaacaagaagatctaactatcctaagtatatatgcaccaaacacaggaacacccagattcataaagcaagtttatggagaccttcaaacagacttagactcccacacaatagtagtgggagactttaataccccatgacaatattagacagatcattgagacaggaaattaacaaagatattcaagatctaactcagcactaaatcaaatggccctgatagatatctacaggactgtcctacttgaaaccatacaattacatggtaattgaatgacctgctcctgaatgacttttgggtaaataataaaattaaggcagaaatcaagaagttttttgaactaatgagaacaaagatacaacataccagaatctttgggacacagctaaggcagtgttaagagggaaatttatagcactaaatcccacatcaaaaagttagaaagagctcacgttaacaatctaacctcacaactacaggaactagagaactgagagcagaaaaacctgaaagctagcagaagacaagaaataaccaaaattagagctgaactgaaggagattgagacatgaaaaaccattcaaaagatcagtgaattcaggagctgttttttttttgaacaaattaataaaatagaccattagctagagtaataaacaagaaaatagaaaagattcaaataaacacaatcagaaacgacaagggggatattaccactgaccccacagaagtacaaacaaccatcagagaatattatgaacatctctatgcacataaactagaaaatctagaagaagtggataaacttctggacatatacacccttctaagactgtaccaggaagaaattgaatccctgaacagaccaataatgagccctaaaattgaggaagtaatacatagactaccaaccataaaaaaacccagtactagatggattcacaggtaagttctaccagttgtacaaagaagagctggtacagttcctactgaaattattccaaaaagttgagtaggagggagtccttcctaactcatttgatgaggccagcatcatcctgatatcaaaacctggcagatatacaacaagaaaagcttcaggccaatatccttgatgaacttcaatgcaaaaatcctcaataaaatactggcaaactgaatccagcagcacaccaaaaagcttatccaccatgatcaagtagaatgcaagttggttcaacatatacaaatcaataaatgtgactcatcacataaacagaactaaagacaaaaactacatgattatctcaacagatgcagaaaaggctttcaataaaattagacatccatttatgttaaaaactctcaataaactaggtattgaaggaacatacctcaaaataataagagccatgtatgacaaacccacagctaagatcatactgaatgggcaaaagctggaagcattttctttgaagactggcataagacaaggatgatctctctcaccactcctattcaacatagtattggaagtcttggccagggcaatcgggcaagagaaataaataaagcgcatccaaataggaagagaggaagtcaaactatccttgtttgcagattacatgacattatatctagaaaaccccatagtctcagccccaaagcttcttaagctgataaacaacttcagcaaagtctcaggatacaaaataaatgtgcaaaaattactggcatttccatgcaccaacaacagtcaagccaggagccaaaccaggaatgcactcccactcacaatcgccacaaaaagagtaaaatacctaggaaaacagctaattagggaggtgaaagatctctacaaggagaataatgaaccagcgctcaaagaaattagagatgacacaaacaaatggaaaaacattccatgttcattgataggaagaatcaatatcattaaaatggccatattgcccagagcaatttatagattcaatgctatacctattaaactactgttgagattcttcacagaaccagagaaaactattttaaaattcatatagaacccagaaaagagcctgaattgctaaggcaatcctaagcaaaaagcataaagctgaaggcatcatgctacctgacttcaaactatactacaaggctacagtaaccaaaacagcatactactggtacaaaaacagacacatagaccaatggaacagaatagagaacccggaaataagaccacacacctacaactatctaatctttgacaaacctgacaaaaacatgcaatggggaaaagatttcctattcaataaaaagtgctgggataaccggctagctgtacacagaagattaaagctggaccccttccttacaacatatacaaaaatcggccgggcttggtggctcacgcttgtaatcccagcactttggaaggccgaggagggcggatcatgaggtcaggagatcgagaacacggtgaaaccccgtctctactaaaaatacaaaaaattagccgggtgtggtggcaggcgcctgtagtcccagctacttggagaggctgaggcaggagaatggtgtgaacccgggagacagagcttgcactgagccgagaccacatcactgcactccagcctgggcgacagagtgagactccgtctcaaaaaaaaaaaaaaaaaaaagaagacatacaggtagtcaacaagcatatgaaaaaaagctcaatattactaatcatcagagaaatgcaaatcaaaaaccacaatgagataccatctaataccagtcagaatgatattattaaaaagtcaaaaaataagatgctggtgaggtagtggagagaaaggaatgcttatacactgttggtgggagtgtaaattagttcaaccattgtggaagacagtgtggcaattcctcaaagacctaaagatagaaataccattccacccagcaattccattactgggtacatacccgaaaaatagaaatcattcttttataaagatacatgcatgtgtatgttcattgcagcactattcacaatagcaaaaacatggaatcaacctaaatacccaccaatgatagcctggataaagaaaatgtggtacatatacaccatggaatactatgcagccataaaaagaacgagatcatgtcctttgcaggaacatgaatggagctgaaggccattatccttagcaaagtattgccgaaaaagaaaatcaaatactacatgttctcacttataaatgggagctaaatgatgagaacacatggccacacagggggaacaacacacactggggcctattggagggtggaaggtgggaggagggagaggatcaggaaaaataattaatagatattatttcatcacccaggtattaataatacctatttcatcacccaggcttgatacctgggtgacaacaaacccccatgacacaaatttacctatataacaaacctgcccgtgtacccctgaacttaaaataaaagttaaaaaaatgcaaaaagatgacataccaaagagatgttacttttcatttttaaaaaagtcaaagaatttaaggaaaattaaaaagaaatcaagaatgacagtagcagctccaaaatatttagaaggtagagttgaaaattttgattttcttagtgcagaaaaatattttgtgctgcatgtttttttaaagaaagtcattttatctgtatatgtgattaaaaccttatttccagtgccatcttcgtgtaattgttaagaacttggattgtggatcacaggaacctggctttgactcttaactgctcactctttaaatggataacccgggtaagttatttcctgtctctgtgcctcagttttcttacaaattggcatgaaaataacagtgcctccttcagagggtaattctgaggattaaatgaaatattgcccatacagtgcttaccacaggctggtagatgattggtattcggtaaacagtagttatttttgttatactaatatgttattaatataattaccattttgtatttttaaatgtaagccataaggaaaggaattattccaatagtttaatttacaaacttgagttttctagaaagacttttaaaaacagtagtgatataaatcaatttatcttaagaaacataagtatctgggccaggcaagtttcagaaatgtttatcattttcaaagtaccaaatattctcgtcaaaacaagctgcttcatcagagttctaattatatatttaaacatacatgcacacacacacgtttgtattacaatattcaaaacttctgaggaagaattatcttttttttttcatgtgccaaagctaaaactttcacttgctacagctgtgtattagtctatttccatactgctataaagagctgcccaagactgggtgatttataaaggaaagaggtttaattgactcacagttcagcatggcagggaaggcctcaggaaacttacaatcatggtggaagtcaaagggggagcaaggacctttcttcacaaggcagcagaaagaagtgccaaatgaacagggaagagctccttatgaaaccatcaggtcttgtgagaactcacttacttttatgagaacagcatggaggaaactgtccccatgatccaatcacctccacctggtctctcccttgacacgtggggattatggggattaaattccagatgagatttgggtggggacaaaaagcctaacgacatcaagctgtaaaaacaatagctaacattcattgactgtttcccagcattaggataaatgtgtgtaacaagaggcattttatttatgtatgacatttgtttatttattatttatttatttggataaatgtctataacaagaaacattttatttaagtataacagcaaatctacaagttaggtactatcatcactcccattttacaggtcgtgaaactgaggctctgaaaagtcaagtcagttttctaatgttgtccagctaatgactggtagatttagtatttgaacccacatttgcctgattccaaagttcaaactcccaacaacatgtggtaaccaaagcaggaacagaagagaaagaagaaatagaagggagggaagatgaacaaagtagacaaagtttagttaatagaattagtggatacccaagaaaaaactatgtacaagagggggaaaaaaaccctgttttctcacatctgggaaacattgatatctatatatttttggttttaaataaaaattaggttatgtcattcatttgcataaaaccatccaaagaagggcctcacaaaattaaaacaaaatccaaactctctactatgggccacaccctccagaacttcagctcgtactatgtttttcctcacacctctcaacataccaacatgtttccacctgcagccctcaccactagttattctttcaatctggaaatattttcgctaagatcttcctatggttaccttcttatcattcaagacttaggttatgtcaggccttccctgactcctccatctgaagtaacccctcctgcttactcctgtttattctctagactccacagaggattcatcactctctgaaatgatcccattaatttcttcttcacttgtttcctctccacgacctgtaagccccaagtggacccggacttggtctgctctgcttacagctggattccagttcccatagtgctagacactaggattaagccaggaaacatgggtgaagcagcaagcacagagcttggggcacagcctagcaaacactccacaaaggaccatgattgtaactgtagtagggcacaccaatgaacaggttgggaaactgagtctctgagaagagactaatgttgtgctggatgaaatttctttttctgacaatacattatccaaatcctccaagctttcagtttaaaggggaaagcaggaactatcattataattttatttacaaagtgtccatgtatgaacattattcaccgccgaatcatctcttcctatgcaagcaacaccgtcctatgcatcaatatcctgatctgtcaggattcaggataaagtggacatatacacactaattgcaaagggaaattgtacatcttgcaaaagatgcaggggtttatagagtcttgtaacattggtgagctgctcagatcacacacatgaccgtggttggacaaggatctggcaaagttaacacagatcaccgaagaaggaaaagtggacaacacaacacagtaagttcttcaaaagagttatattagaatatcaaaagattatgttaggcctttgggaaaactcaaaactttatgaagacctcaaaaaattatgcaaaaatgacccttcaatggtcatgctgcaagagtcaaatgacacttcaaacaactgcggctttctatgttgtgcaaatgcatttgttgttttaaaggtcgtaaagtcagggtacacgtggcagatacttatgacttggaggaagacgttagattagatttgaaactttcactgaatgatcgcatttcatgcttttcatctgtacattaaaaagccagaatgtctttgccaagaaattctagcataaataaaagaaaaggatgggattttggaacatcatggtagaattcttgactatcagctttatacaacatgtctggacatttagtgatggaaatgctggattccaaaggaatgtaggcaaaggtactactacccccatgctcttcagaaaacatcctctaaaagcaacagtgatgatcagatactgtggggcaagactgacagtgacactcaagatttccactcttctctttaatcatatatttcctgtcattcatgtgctacaaaactctggaatatgcaaagctcattcaaatgcaaaaccagcctttgctccaacatgagcatatattttcatttaaagacaaatcagatgtttcatttgattttttttataaatctgataataatgtacatttaacccgtgtttacaaccaaaataattaatctctctgaaccctttgtttttcctgtctctatcctccaccctcattgccagataaataacatctgcaacctgatgtggcatattgaactttgtttatactcacacaaacacgtataagcatcccagatacacatatacagggactgtatctgtccttgttgtttttatagaaattggatcacattagacatattttctgatgacttttgtacattatagttggtcttcacagtcaatagctccaaagctatcttatcttctaaaatagctgcataatattcctcagtatggatataccaaaagatatttaaaccattgcctaatcaatgaatatcctggtagtttccacattgttttttccatttccactatagtggaataaactttcgtgttcaaaaatcctaaactggtgctatatttctatagaatagaggcacagatgtagaagtgttaccctcaaatcaatatgcatttagttttgaaaaacagacactgccatattattttcttaaaaaggctctacagattcacatttccagcagcaatgagtgtctcaagcaccttttaagtggtaagcagcttaccaggggaggtggcctattattctatcagtggcttcagttgttaggacaccacgggtcagctgtggagatacggttgtggggcaggttgagttcaggacacatagaagattgccaaagggtgactattattactttgagactctggaaaaattagccaggaaacagagacaagaggctcagggtgcagcaaagcagccaaatcaggatgatagtgttttctttggagcagatatactaatggccaaggaactcataaaaagatgcctaatgtcatctcattagggaagtgcagtcaaagccacagcatgatacgtcttcacacccacgaggatggccataatcagagagacaataaccagtggtagggaagatgtgaaaaaatcggaatgctcatgcattgctggtaggaatgtgacatggtgcagctgctttggaaagcagtttaacagttcctggaaaagttaaacatggagttaccctaagacccagcaattccattcctaggtaagcaagaaaatgaaaacatatggccacacaaaaacttgtacacaaatgtccatagcagcattttcataatagctgaaaagtggaaacaacccaaatatccatcaattggaaaaaggaaatctagcatttgcatataatagagtattaatcagccataagaagaaacaaagcaccgatccatgttatatcatgctttatacttggaagcatggtactaagtgaaagacgccagacacaaaaagcaaaatattgtatgattccatttatataaagtgtctagaataggcaaatccatagaggcagaaaacagattagtggttgccagtggctgggaatagggaaaaaactcagcgctaaagggtagggagttttgttttggagtaatgacgatgttctggaattagacgtggaacgattgcacacatggtgcaaatatccttaaaatcacggaattgtcactctaaaaggtgaattttatggtaggtgaattgtacctcaatttgtaaaaagaagaattagataaataaacagcaacacagcaccaaggggtgggggtaggaaacagacaacaaataggagtgaagagttcacaggaaaagacatgcagccagcttttaagcagaagaaaagatgtttggcctcataaatagtaaaataaaagcacaataaaattatgacacttggctttcccttgccaaattggttaaaaaggagacaattgatgaccccagtggaaagcgtataaaaaaagagcagctgtggctgggtacggtggcttaacgcctgtaatcctagcactttgggaggccgaggtgggcaaatcatgaggtaaggagttcaagaccagcctggccaacatggtgaaacactgtctctgctaaaaaacaaaacaaaacaaaacaccaaaaaatagctgggcgtagtggcgggcgcctgtaatctcagctacttgggaggcggtggcaggagaatcatttgaacctgggaggcagaggttgcagtgagccgagattgtgccactgcactctaacctgggcaacagagttcagagtgagactctgtctcccccaaaaaaaaaaaaaaaaaaaaaagaacagccatatagatcgtcggtgggagtgtaatttggccacttctttggaaaatagctcagtaatatctattaatacttaaaatttcacaaacactgtaagtctaacttccacttctaaaatgttatcctagaaataaaattgcataggggtacaaaggcttacgtatggaactatttgctggactactgtagttgtggcaaaaaactggaaatgacctaaacgcttattagtagaaacctggttaaataaattatcatatgtccttgaggacacagggacacaaagaggggaatgacaggcactgagcctacttgagggtgggaggaggaagtcgatcagaaaaaataactagtgggtactaggcttagtacccgggtgaaaaaataatctgtacaacaaacccccatgacatgagtttaccttataacaaacctgcacatgtaatctgaacctagataaaagtttaaaaaaataaataatcatatgtccctacaatgaaatattccacaggcattaaaattccccaaggaattttagtaaggaaagaaaaagctgtgcccaacagcacgtacagtatgtttccatttgtttttaaaaaatggtgtcgggaggttgaggagacaacttataaatagacatgcctgggatacctctggatataagaaactgtaaagtatttacttctaaggaaggaaatttgggatggggcttggggagccatcagagttagggtggggattttttctctgccttatcttattatgtatatcgctcagaatgtttgctatgtgtatgcacctaccccatccattaagaaatgaagaaataatgaaaagaaaaaatgaaagtagggaactagaaatgagaggtgggattcaaagtggactgaacacttgacctatttcccaatttgcctagggctggcccagcagcgaggcaggttctaaccaatgagcatcagctttgaatggaggggctgataggccaggtgggccctgcttgctgagagtgtcatggccttagggacatctccatgttgcagagtctgagcctctgcttggcaaattcagaaaatccagcttttctttttatatcacctggagctgatgtaactctcagaaggcatttttaagaggactcatgaattaaccacatagccaacttactggcttaagactacgtgacagaaagctgcaaagggggccagccactggtaacatcccaccactgtccctctctgtggaaaacacagatgggatgcacattgtgacgggcaggatgcctggagagcccacaaatctgcaagcacagctgaaattggttacaggatttcaatgtttcattgcttgaagctatgataacttgatgatgatgatgatgatgatgatgatgatgacgatgattttttttatagccatctttttagagggatttgaggtagggaaaaaaataaacctcacactatcggaggttgccaactatgaggtctgctgatggtttggccaacacagtgtttatatttttttgaattgggaaatttcatttaaaagtcctaaaatcaggctgttattgaaatatcttattattggctcagggtttcccagggcagccatccttgaagctgtgtggagccctataaacaaggacgctttccagttccctgcaaactccatttcattcagagccttgagccagttcttacatggtcctcagacttgagctagtgcaagaatacccgggaggggttgtgggaacagatagctgggccccacccccagggaagggggtgtttctgactcaggaggtctgggctccggctacagaaactgcacatctaaccggtacccaggtgatgtgatgctgctggcccagggacaactctgcgagtcactgctattgggcactgctattgcacccacacaaggaggcaggctctgcttacatttttcagttcttgttcccagaaacatttgctctttggggtatgctttgcatataatggatcctacccactaatacagtatgctgcttttattgataaacttccagaaacttgaagcgcaccttaccatttctttgatctcgctgattatttttatttttgttaaatgaaaattgttggtaagttctttttggtgtggtaaaaggatatgaaaagctgattttaaaaaaatgtccactctaggattagaattgtaggtgtgtttattctatttcaagatctggttaaaatgcaccttgaggaaaagaattgagtgcagctgttgttatttctcaatgctgtttctcttttcatgtttttttcatgttgtctcttggtctgtcctatctctcttggtctatcctccaagacagagatgagtgatcttgaaaccctgcccatgtttttatctttggagcccaactgtgctgccttgttttcttctccatccaaagaggcaaagagaaagttgcatattactcaacagcagttgcatgacagttaaaatcagactgtatgagtcatggaacagtaagttgtgtccagagtatctgtcatggtaagtacaaaaaagtccttaaaaatttaaaacagaaatgccaatgttttatttttgaaaaatgtgaagaagaaattttccggccgggcgcggtggctcatgcctataatcccagcactttgggaggccaaggtgggcagatcacctgaggtcaggagtttgagaccagcctggccaacacagtgcaaccccatctctactaaaaatacaaaaattagccagatgcggtggcacgcgcctgtaatctcagctactagggaggctgaggcatgacaatcgcttgaacccaggaggcggaggttgcagtgagctgagatcataccactgcactccagcttgggcagcggaaggagactctgtctcaaaaaaaaaaagaaaaaaagaaattttctaagtgtattccaaataacttttaatattggataaacattacgagtttaaaaatacttatgccagaggagtgctgtgactcgtgcctctaatcccagcaatgtgggaggccaaggagggacagtcacttgagcccaggagtttgagaccagcctggataacaaagggagacctcatctttacaaaaaaactaaaaaattagccaggtgtggtggtgtgtgcctgtgatcccagctacacaggaggctgaggcaagaggattccttgagccctggaggtcaaggctgcagtgagtgatgatcatgccattgcactccagctgggtgacagagcaagacctcatctcaaaaaaaaaaaaaaaacaaaacaaaacaaaaaacttacgcccaggtaaaaattgtcagagaaaaataagaaaaaaactgaatgcccaaaattagcataatggctgaatgaattatagtatgtctataccttgaagtacattgtagctttaaaaaaaatgaattaaagttataccagttgaatttggagttgagatggggaagattattacaattaaaaaaaaacaaacactattaatggatgtgctgggaaatgtctgtatggggctagttaaagtaaattaaaataaagaccagacctgaagaatccctgagcggacaaagcctgttagaccacataaatgagctaaaccttgcttgatttgcagacataagcaaaacaactcgaactgtttcttgtaaatgcctatgctaaagaaaaacagaacttgagctcaaccaatcagaaacagtcaacaaacttaaaattatataactgggtaccttccaatgagatgatcaaataaggcaactgtgtaattgtaacacatcaaacacattttatattatgcctctgcattttcccttaattctggcatgtaatgctttgtcatcaaaacactaattcccttttggttttcttttctcaaattaatgaattgcctctattcagatacactctttgaaattttattgtgtctcagatttgtcttttacaaagtatagaacaaagagaaaaatatgaaagaagaaatattaggttgttagcttgggtgtccttggagggggtagggaagatgtgagatgaggaagaagccaataagaaaaagaaaaagacaggtttcaccaaaacaacaataacagaaaatatgattgcatttattcatatatgttaattggtatgtatgtaagtatatatgcatgtaaaaataaaatacaaagaattaaaatgcatactaatagttatttcagttatctatggctgtgtaacaagcatccccaaaatgattgacttaaccaccattttattaggtcatgattccatgcattaagaattcagggccgggtgcggtggctcatgcctgtaatcccagcactttgggaggccaaggtgggtggatcacgaggtcaggagtttgagaccagcctgcccaacatagtggaaccccgtctgtactaaaaatacagaagattagctgggtgtggtggcgggcacctgtaatcccagctacttgggaggctgaggcaggagaatcacttgaagctggaaggcagaggttgcagtgagccaagatcatgccactgcactccagcctggtggacagcgcgagactccatctcaaaaaaaaaaaaaaaaaaaagaattcaggcagatgccaggtgcagtggctcatacctgtaattctagcactttgggaggctgagatgggcagatcacctgaagtcaaggagttccagaccagcctggccaacatggtgaaaaccagtctgtactaaaaatacaaaaattagccagacatggtggcacgtgcctgtaatcccagctatacaagaggctgaggcaggagaatcacttgatctgggacgtggaggttgcagcaagccaagatcgtgccactgcactccagcctgggtgacagagtgagactctgtctcaaaaaaaaaaaaaaagaattcaggcagagagaggataggatcagcttatttctgctctatgatgtctggagccacagctggggtgccttgaaaggatgaagatggctgggacggctcacacagggacatatgtctggagctttagttctggctatgggctggttcctatggtccttcctcatacggcatctattagctgaaatgcccatgatgtcttctttaatcacaggtctggttcctggactgggatggctggaatatttgggaactggctgggtacctctctcttgcctcatggcttcttcatgtgactagcttgggctctctcacagcatggcaatctcagggtagaacttctgatattgtgtctagcctttctcagagctagtgttgcaagagacaaggcagaagctccgagtcttcttaaaaggcttcttgaaagtcctgtgtcatcccttctactacatactgttggttatataggaccagcccagaggggactacacaggggtgtgaataccaggaagcatgggttattgcgtggtgggttgtatgtgtgcatctttggagactatcaaccacaataatgcaatagggaagataattttatctaacaggaattctccactagactttttggtgagaaaaagcactgagtttgagaaggatgagatttccccagggctcttgctcactcccaaggaagacagaggcacaaggagctgttgggccatctgggagagccagtgttcagaactctctgttattactttagactcagtggtgatacagtgcaatggagggaaagaagaaaggagagtgcctgtgagtgttaccagtggagagttgtccaggttcttggtgttttgaacaaaaaaattggacaaaatgcacaaagcaatgaaagcacagatttatagaaatgaaagtacactccacagagtgggagcaggtttgagcaagtggctcaagagtgctggttacagaaatttctggggtttaaataccctctagtggtttcccattggttacttggtgtatgccctatgtaaatgaagaggatgaagggaagttacaaagttatttacttggtgtacaccctatgcaaatgaagaggatatttcctgccatagctgaagtgcagttacatccatagttgagcatagaaagttgtgggttttctgcttgatttagttctaggaagtccttagcttccccgcctccagaccctattcccctacctcatgaggatggggtgtctcacagagtttcaaggtggagagttgaggatagggagcctcttgagtgagagacatatagcaatgtgaggagagagaaaagtggtgtttaggatgtgagttagatctccttaatgtcttttgaaaggccagagtgaggatatgaactactttcctttgctcaattctaataattctttggaatcacctctggcagacactgtttgtggcctgcccaatagccaatcgtctccagccccaaccatgtattattattattcacttgcatctcaaagagatgcttgattcccagtatcccatgcagctggtatgggccatgtgatgtagctctggccaataagaggatgcctacatggtggcagaggcttcagggaaggatcctccttcctcgcataatacaaggagaaaaaaaaatggtggcaaagtttggcctttcctctcctgcttttggatcccatgatgtagagatgtgatgtttggttctgtgacagccatcttgtgagcaggagtgacacaattggctcatgtacttggtgttttgatgaggctgtcagactgctgtaccaaatttagaactgccacctccagacttcttgctcaaattaaaagtgctatttacttatccagggttgcattccttgaagctgagtgcagcagagtctgggaacttgcccttcggccttattattttattcctctgctaccactggcttaatatgccactgttcattgatcaaccatttctaagtctttagtgtatctcaggccttgtgctgagctctgggaccctcataacaagaaaggatggcaagcgtcctgctctcagggacttttacttgagtttggaaacagataaaaaataagatcaattggagggaaatagtggacactaggagaacacatgtatttgctcccttccagacaagtgctgttgcctatattttttactacatcagggagctatgctttttggcatcaggtctcccattccactttgactaggcattgatattggcaaatgcttctcttctcactcattatgttattggcaggagcacttttctcaagttagaattttcaatccaataaaatgattccacttacatcttttttttaagaaaagcaaaattagtctattctttttaggaacaatgactaggagcaaaaaaggaaaatactaattttagaaaccttttatccaggtcaaacattccttctgtttctggaaaatgacgtgtcctggcagggaaggcatgtcttagtctctgccatacgttagcagtgaggcctgagaactaatgtcataaatttgctagaaaggaatcaaagaaggccaaaaatcaggcatttttatttctccaaagatctatgaagttttaggcataaataatatgcaggtgggaaaatctggtcaggtgatatgtcagggaaagccaatggtaaagaataagtatgaaaatagcctctactttttttttttttttaaatagagatggggtctctatgttgcccaggctgaactcaaactcctggactcaagcaatcctcccacctcagcctcccagagtgctgggattttaggcgtgagccactgcacccatcccaatagcctctacttttagttttgcccggactcctttatttcagcacttttatcttgtgccagctgctgtttttagagctcccctacaaagttcatactattattccagttttacagatgagactcagaataaacttccttgccaaggttgtacagctagtgagtggcagagccaaaacctatgcttgggtctgttagagtccaatgcttgagaggatatggttccatttccgattgctgtaatgaattatcccaaatgccccagcacaaatatattacagttctgaagcctgtaggtcaaaaatgggtcagcttctagaagctgtaggggagaatctatttccttcttttctctggtatccagaggtcacctacattccttggcttgtggctccattctccagcttccagtccagcagtgtagcatctttaagcctctctctctttgtgacatctgctcccataatcacaccttttcctactccaacccttctgcctccctctcatgaagacccttgtgatcacactgggtccacctggataatccaggataatatcatcatctcacattccttagtcacatctgccaagtccttttgccatgtaaggtcacatactcataggtgctgaagattagatgtgagcatttgatgggaggaagggcaccgtgccttgtgctggactcttagctataatactctgtggtctcatacatgaagaaattgcataagtaagttgcactccctagtgtatgcactctcagtggggatggtattaatcccaagagggcgaaaatggttctatgggagaggatgaacaaaactcattctttttacgtatagagcacagatacagtacatacacagatacacgtcagtgatattacaatttcatgaatgggatgcgcttagctcttaatgcattacctcgtctagtcctggatgtcacctgcgaggccaacgtgtcatctcacttgcccacctgccttctttgccctggccgtccacgctctgcctccccttgcgtccctccccaacacctcagctctgcttgagtgagaagatgactctggggtcccccttgagaacatatgtgccttttaaaactatgtttttgttattgaagaacaaatgttaactaaatcacatcagcattagctgcactctcacagagcttggttttatgctaatactggccatctatctctttaggtgggtcttttgcaaagaaacaaactagaaaacaactatattctcaaggtggtaaaaagcctttttaggtatttccttcccagaatctctaggcttaggctttctcttctctttttagcttttgagtgaaaaaggtaaggagcagccgtcattctcctttcttattggtgggaaagtgattgttgcatattaataggggttgtggcacctccgtggtaatgtttcactaaatggaacagcatattctctttctaggatgattaattttgtgtggcctgacagtggtgtgtgggactaaatgttctgtcctttctaactgcctgatctctgagccatgggagattgagtttctccttcacaatccaccaaagtttgcatgtgaacaaaacaggggatctctgtacgcaacaggagggtgatgtgctcaactgtgaagtgtggtcctacttgaagttgtctgattcaatgagatgcaataaattaacataccacatgtattggggggaggtgaagaggtaccagatgacagtctcctgaggtctccctctcttgggcagtatatgggaggaatgggctgacaaaatagctaagagatgtcatctcttcacaaaacacctccccatcacattactttcttttgtgcagactcctcctgcccccagtgatgaatccagaggaagcaaaagaactggttgagcagaagacacccttctaacatagcaaatgatctttccccccattctttattgaatttattttttttctttagttgatgtgagctgcttttgactatgctggttttttttttgtttgttgttgttgttgttgttgttgttgttgagatgaggtctctgtctgtctcctaggctggagtgccgtggcacgatcttggctcactgcaacctctgcctccctgggttcaagagattctccttcctcaacctccagagtagctgggattacagacgtgtgtcaccacgcccagctaatttttgtatttttagtagagacggggtttcaccacgttggccaggctggtctcaaactcccaacctcaggtgatccacctgtctcggcctccaaaagtgctgggattacacgcgtgagccactgcacccagccaactatgctgatttttaaaaaacttcattgtaccttaacagcatttacaaaaatcagatttatctgattgaagtataattcacatacaataaaatccaccaactttaatagcacaattcagtgcattttgacaaaatatgcagtcatgtagcctccaccatgatgaaggtataaagcttctccatcattgcaaagtttctcgatgcccctctgcagtgagtgtctcaaccagccccagcccctagcaaccactgatctactttctgtcactacatttgtgccctttctagaattttatataagtggaatcatgtagtatgttgccttttgtgtctggcttctttttcgtagtataataatgttgagattcatccatgctgttgcattgatcagtagttccttcttatttattgctaaggagtataccatctgctatagcctgaatgtgtcccccaaaattcatatgttgaaacttagttaccatgtgatcatattaagaggtgaggccttaaggaggtgattgagtttagagggcaaagaccacataaatggaattatagactttataaacggacttgagggaactagttagtccctttcctgcccttctgtcgtgtctgccatctgaggacacagcattcctcccctctggtgggcacagcaaggcgccatcttggaagtagagaacagggccctcaccagacactgaacctgctggtgctttgatcctggacttcccagcctctagaactaagagaaaaaaatttctactttttataaattaccagatctatggcattttgttatagcagtacaaacagattacgagaccattgtacggatataccctaattggattatccgttcttctaatgatagatattttgctctaataattctcaagatatttttgggttcaaataaaacaactatttgaaaaggatggagacaaattgaggatactaatttaaacaattgcattttggcagaacaagcacataagcctctcacccaaagtttgcaagcaaatgtgtttgtcttagtggcattgcaggtaaatcacatggtatgttgttttaacatcattagcaacctactccaaaacgggacactcaaataacatctaaaattggtgagttaagctagaaatataacataagcaaaaactgagacattttgattttttaatatattgttacttaagatgaataataataccaaacttttgagaaagatctccaatccacatggattgtattacttaatgtttgtttgatatcaaattcccatggtggtttgctcttactaagaaaaagcactctacacgatacatttctttctaggaggatacagaatgtaatttcatgttttagtttaaaagaggtattttccctgattgatatctctcacattgtatcgaaagacaaataaaagacttacaaggcataagggatgtaggaaagactagttttaacttttgatcttaaagttccaaaagatatgttaggcagaaataatacagttaacttcaaatagcaatggcagtctttatgtcaattgacattaaatccaagacagaataactttccttatgtgtttaccacatgccagacactgttctgagagttttaggagtatcaacttatttaaaccgtacaataacttagaagctttggtcctatcattattataattcccattttacagatgacagaacaaagaagctcagaaacctgcccaagctcacatattggagccatgattcaatgtagcattccagcctctttggctgtttgcttagccatggtaccattgctgcttctaaataagccttcataggaaatattattggatgccaatggtattagtctgttctcaggctactaataaagacatacctgagactgggtaatttataaaggaaagaggtttaatggacttacagctccacatggctggggagacctcacaatcatggcagatgacgaaggaagagcaaagggatgtcttacatggcagcaggcaagagagcatatgcagtggaactcccttttataaaaccatcaaatctcgtgagacttattcactatcatgagaacagcatgggaaaaacatgcccctatgattcaattacctcctactgggtccctcccatgacacgtggggattatgggagctacagttcaagatgagatttgggtggggacagagccaaaccgtatcaccaatgaattgttttaattgtaatttttgtaagtaggaaaagtatagataaaaagaaaccaaacagtcaactagatttctatttacatatttttccaatgacttttctatacctctatacatatatgtatacaccaatagagatcaatagaaatgtgcatcaaaagacatggtcaaataattctctctgaaggacaagaaagggtcacccagaatttcacttttataccccttaaaactgcactgaaaattataacttagctaataaccttaggaaaactgcatgaggacaacaataagcttaaaaggggtaatcactctaaagcaagtttcacaggttgaagatgtcaatgaataacaggcaaaattgctacctcgggattaactgggactctttacaaactctccagcagtagctgaggatgttgacagcaagactgccaggtgtgagggcgaggtacaaataacccatgactcagaaatgtgtgtttcttttccctcgtcatgtgcaggtgttcacacggcaactgctgtctcagactgttgtcctacgtttcaagagaaacctatttccctccttttgggaacatctttgtaatatacatacatatatatgaaatatgcatatatatatgtatatctcaaatatgtgcatacatgtatgtgagacatacacatatatgagatatacctatgcatatgtgtatctcatatatgttaacacacatgcataatatataaaaaacataaatatattacaggtgagagaggaaagaaaagagaaagtgagatggaggatggagagaaggatagagaagaggctttctcaatcccaacaatttttccctattcattccttgcccttgcactccatattaaacataagaagataattgaaaacaaacaacccgattaaaaattgggacaaaatgagaatgtaaactggcgtagtcattatgggaaatagtatggaagttcctaagaaagttaaaaaataaaactactatattagtctgtttttcacactgctgataaagacatatctgagactaggaagaaaaagaggttgaattggacttacagatccatatggctggggaggcctcagaatcatggcgggaggtgaaaggtacttcttacatggtggtggcaagagaaaatgaggatgatgcaaaagtggaaacctccgataaaaccatcagatctcatgagacttattcactaccatgaaaacagtatgggggaaactgcccccatgattaaaattatctcccactgggtccctcccacaacacatgggaattatgggagtacaattaaaaatgagatttgggtggggacacagagcaaaaccatatcaactaccatatgattcagcaatccacttctgggtatatctaaaaaagtgaaagaagggtctcaaagtggtagctgtagccccaggttcattgcagcattattcacaatagccaagatatgggaatgacctatgtgtccatcagtggatgaatggaaaaaggaaatatatatatggacacacacatatacatatacatgtgtgtaaatacacacacacaacagaatagttattcaatcatacaaaagaaggaaatattggcatttgaaacaacatggatgaacctggaggactttaggataagtgaaataagctagacacagaaagacaaatactatatgatctcacttttatgtggaatctaaaaaagttgaattcatagaagcagagagtaaaatggtgattatcaggggctaaggtccagggaaaattttggtcaaaaggtacatactttcactcataagatgaataagttgcatggtaaatataagttaataatactgttttgcttacttgaaatttgctaagagtagattgtaagggtcctcaccacaccctacaacaaaaacaaaaaagtagctatgtatggtggtggatgtgttgaatatatatatacacatacacacacacacacacaccatggaatactactcaaccataaaaataacaaaataatgtcttttgcagcaacgtggatggaactggaggccattatcctaagtgaagcaacttaaggacagaaaccaaatactgcatgttctcacttgaaagtgggagctaagccatgtgtataccggggcgtagggtagcataatggatattggagactccaaagaagggagggtgggagtggaatgagggtgaaagttacttattgggtacaatgtatactactcaggtgacaggtacattaaaagcccagactttgccactatataatcacatccatgtaaccaaaaaccacttgtaccctaaagctatgatttttttttaaaagaaccttctacagagcccccaatagttcaggttctcagtccccaactttagggtattctgaatagcagctacgggatgagactagggcatggaatttttaatacattccctaggaaattctaaaagctttggaaccaatgctgtaatatacctccttcattactcaggaaaggaaactgaagcccagaatcttacatgtgaaagaaaacaaccataaccataatatgataatgataggagcacttattatcagtcaggcactgtaatatgtgctttcattatatcagatgcttatgctataagtactgtcattattcccactgtacagatgaggagccagaggttcagagaggttatgtaacttgctcaaggtcacacagctagtacgtggcaaagctagcaatctgattgcagaattcttaccctcaactactgggctatactacctcttcttacataatttatatgtatccgtcacatagtagagcctgaccaccctggaagcattgaatatacagtcttatactccaggataaagtcaaataggtaagtatatgcctcagttttaacactgccctcatgtggacacaattctgttgtcttttataatttatcagcttctgaggaattcctaagtgctgataatggcagaggctgtgcacatttggggaaaaggaatatatgaaatatcgctggagactatgttaaatgtttaataaacaacctcctttaatcctgatagcaattctgtgaggtaggtacttttatccccattttacagatgagaaaactgaggctgagaaaagcagatgccttgttccaggtcacacagccagtaatctgcagggcagagattgcaacctaggtctgccaagcttcatgttttcactctattgcttttatcttatctgctgtaactcctcagtctcctccagctgtcacacacactcagaagagatctgttgttatggctgaatcatattgcccccaaagatgctgaagtcctaaccccctgtgaatgtgaccttatttggaaacaggatctttgcagatgatcaagttaagatgaggttattagggtgggccctaatccaacatgactgcttccatatgatgaaggggaaatttagacatgcatagagggaagatgacatgaagatgcagggaggagatggccatatctacaagccaatgagaggggcgtggaacacgttctccctgatgacccgcagaaggaaccaattctgctgacaactttattttgaacttttggccttcagcactgtgagacaatacatttctgttgcttaagccaccagggcatggtagcccaaggaacaaacgcaagtattttcaaactgagcctgcggcttcgaccctttcatttttttttttttttcaccgtaaacagcatctgcagaccccccttccccacgagagggtagatgcccttcccagagtagcactgaccttcctctaagtgctgaactgtgtgggtcgacaccaccactggaaccccgttcagagcagacgcgttgtcctgaaacagagcacgtggcattgtgagacaaatcttcgggggaaaatcagaagaactcaaggaagaacctctaagatacaagggtgtctcacaaaaaattaaacttaacttaaaggctgtgtttctagaaactccccagttttctatcatgccttggagaaccaaaataactcactccaagagtggactccagttattatgagagcacaccatggtgcctcagctcaggggaccccacactcacaggaagctctgacccgtcgcacggaggggaccccaggctcaaatgggcatttgtcaagtcagggctggagcacgaatttaatatgctgattctgacaccttttaggttatcctcgctccactgtcttgcacacacagacacaatcaatcagcagccaggacttcagtcaacacacttgtcaaatacaggaagttcttttttttttttttttttttctgctgatgcccctgtaatggttactacactacctggtaagtctctgcttctggttcattctcttggtcttcaactctttggggaacactcatttggttacccattgctcctataatggagagaaagagaggaagagagaaagaaatcaaaaccaaacgaagctacatgtgctactaaggtgcagaggcctgacaagccgcccatggctgtattatcatcagctgagatcagaacaaattgcttgtattagtccgttctcacactgctatgaagaaatacccgagactgggtaatttataaagaaaagaggttgaattgactcatggttccgcatggctggggagaccgcaggaaacttacaatcgtggcagaagacacctctccacaggacaccagaagaatgagtgcgagctggggaaatgccagatgcttataaaaccatcagatctcgcgagactcactcagtatcacgagaacagcgtggaggaacccgcccccatgatccaattacctccacctggtcccatccttgacgtggggattatgaggattacaattcaaggtaagattttacgtagagacacaaccaaactatatcattgcttatatttattttgggaaatagaaaggagattttggactcatgtattcaacagaattaaagttaaatgcagtcataattttcagttgcatttcattgctaggggaaaatatttatcatcatgaaaagtgtattcagtgtagatagcatttttttctcttttagttaaagtcacagctattaggattttagaatgagggtaattgaaataataatatttttttctgattctcaaactaaattaattcccctattaaaaccttttacactacggccttttttttttcatagcatttagcagggcttgtaattatatacttacttgggtatatattcatgctttcactgatttagcacatatggtcatgtgtcacttaagggcgagaaaatgttctgagaaatgcatcattagatgatttcatggttgtatgaacatcatagatagtatagcctactacactcctaggctgtatggtataacctatcgttcctaggccactaacttgcacagcacgcaaccacattgaacactctgggaaattgtgacacactgggaagtatttgtgtacctaaacatatcgaaacagaaaaagtccagtaaatacatagtattataatgtcatgtgaccactaagtatatgtggtccatcattgactaaggtatcattatgcagtgtatgactgtgtctattgagcacagctctgcacctgttgctgggctgggcactagggttacagctgtaaattaaacaggcaaggccctctgacttcatggagctgaagtatggtgcacagggagagagttaacataggaacaataaatccacaaacgaggttgtttctgatagttcaaggcagcatggcacagtggttatgaccacagactctagagcaagactgcctgggcatgaatcctctctctgccccttgtagctgtgtgtccttgggagagttaattagcctctctgtgcctcataagactgctataaggacccaatgagttaatgcttgtgacgtggttagaacaatgtctagctcatgttaagcaaaacatatctgcttattaaacaaaaatgcatagggttctaagttatgaataaaagtaatttttttttgagacggagtctctctctgttgcccaggatggagtgcagtggtgcaatctcggctcactgcaacctccgccttctgggtttaagcaattctcctgcctcagcctcctgagtagctgggataacaggtgcgtggcacaacaccagactatttttttttttttttgtatttttagtagagatgggttttcaccatgttggccagactggtctcgagtgcctggcctcatgtgatccacccgccttggcctcccaaagtgttgggattacaggcatgagccactgcgcctggtcgaataaaagtaattaataacattacgtgagatgggatcatatgggagatggcaggttgtggcactgctgggtaggatggttctgaaatgactgttaatgtggttattgtcccataggtgaagggcaaagttgaatatttaatttatgtctcccttccacaagaaattgtaagcaccctgacgtcaaaggcagtgtctaccttcacccaattttgtatctcctaatcttagcagtgtgtttgcatttactgggagcttaattattgttagtcaatggagggaataacgattgatagcatctctcacatatgaggcacagacctaggtacatgaccacatcatcaccaaacctctgaagagcttcgttataataatgtatgatatataataataatgatgataatagcaaatcattacttagcatgttctcaattccaagctctaattttggagtgcttcacctgtattgtctcatgtagtcctatagcactcctgtgagatagaggtatcatgatttcattcttcatatgaggtagccgaaactcgagggggttaaatcattttccaaaggtcacccagttaatgagcaagattcaaacacagtctggctgtgctcctaaccaccggaatgttctgcatattactagcttcccttaaaaaggaggaatggaacctccaagacccaccaagggcaaacatccagtgaggaattgactcctagtatatctgatccctacacaaggactcttgcagccactccaaaggcctgctgtcttgccacctaaagttcttttgcacatgtaattccaatgtagcccatctccaaagacctagcttctggcttatctgctctagtggctctcggaataaaaattaggacttttgatttctggctgaaaggagtcaatgagtcaccagggattcttgtggatctctcgccattggtgtgagtttttattccctggtagtagacgcattgagcaattagatattgaggaggccaaaaaaagggtcatggatctcaccatgtgttctcttgcaggaatttaatacataaccaaatctggggattttgtatgtcttctgatcataccacataataaagctgagcactgttaaaacatgtaggacacttgttgttttgtgctattttctatttataaaatccgtgactcacacacttgcatcagatcatcgcttctgtctgttaatgggacattatgaataatataatattgaatcctcaagaccagggttggcaaagaacagcggtggctggattcagctcactgcctgttttagtaggccagtgagctaaaaatgagttttaaatttataaatggttggaaaaaaattagaagaatcatagaatgtgacacatgaaaattatatgaaagtcaaattttggcatccataaataaagttttgctggaagatagtcatgcccttttatttatatattgtctatgatggctttcatgctataatggcagaactgagtagttgcaacagacacctatggcctgcaaagcctaagatatttactatctggctctttacagaaagtttaccaggatttgagcctactgtgtataaaaacaatgacaacaactctaaaaaatcatagaaatgatagagtaataacaataacaacatttggtgagtgcttaccatctgttgagaaacttctaggagctttatttgcagtaaaactaatttgctctttgcagcaattcaacaagacagaggtattattatttcaattttgctggtgtggaaactgaggcacgcaggttaaatgtctcagtcaaggatacgcgcaaacacatacgttcatatatacacatgcaagaatatatacacacaaagtatctctatctaaattcagcttttaacaagttttaaaattattttaacagtaggattacaagctttattttaaagctcttactatttaatgtaaattcaatcctaacaaagctactttgaatcaacacttgaggttatgaaaaaccttggtgctggaagacgcatggtgtacagaagtaggagagaagatttttcttcccacagagttggggttacattattctgatcattgcacaccctaagtagcctctcggccacttcaaggtgaagggccctgaaagaaggaaaatctaatggcgtgtctttttcagtgataacctggattcagatattgtcactctccaccagcagatataatgcatgtgtcgtgaaattgctcctgcctgtccatcaaccttttaaagaacaggattcatctgggtgggacaaaagcaaaaggttactgccatctattggctgatgtcaatattagcagaaatgaattcagcctacaggactaggtccaaacaactgggaaggctgaaagaagcattttgatgttttgcaatgaagccttctgttcacagttggcaagaagatggcaactccttcagtgccccaaaggtcctggaactcgtaataatgataaccatatatgacttgtatggagagcttgccgtatgccagcccagtgctgaagctctatgtagacatcagtgtagcacataggataggaatgtgggctctggagtttggaatccctgagcatcactgagcctcgctgggcctcagtttcctcatctgtaaaaatggggataattatagcctccatctcaaggggctggtatggagtcaaaccagtgaatataagcaaagtgccctgaacagggcctggcacataaagaggactgcacaagagttagcatgagtaggactctcacgggtatgatccttgctctttgaagccagtttctcccacaggtgcccggtagtgagactctaccgaggaatccagcaacatttctgattcctgtgatcctctcaccgaaaagtcaatttggggccctggaatttgtatttttagcaaatgccccagtgattctcatgatcagacacctatagaaaatagtgtgatggtgaccatcttcaagctttttccaggagtgaggatgctctaggacacaggactcttatgttaaaattggaaaaccctgggcaaaccagaatgacttgggtggagacttttttttaaatccccgtttaatagatgggaaaactgaggctcaaggcagttcagacagtaattcttgtctgtaatagttttctcccatttctcaaaaaggagaaaaataaatcagatagagtttttcatgataaacgtacaattgaaagagctaactttcatttttgaaaaagaaaaagtttgaatggggtgttaaaatgccctttctttcatgaactgattatatgagtgttttgtctttatgaccttattttacattaaacatacgaagctatggtgggtggaggggtgttgtttttgaaattagacttgtgtttgagggtttggcactttgccactgggggttgattgtggaggttcagatgagaaagccccttcacttccccgcctcctgcctgtgttatgggggcccatgcccagactgggctgcatgtgagaacctcccacagagttctgagatccccatgcccaggcccctgccaaactgatgacagcagattctctggggtggggctgggcatcggggtactttcaagatctctaggtgatttccatggctgagagcccctgttttggatatttctggggtgagtgagtgagtgtctcctggggtcagaactctcctggctgctgcctaccctgacctagacaaccaaacccacggattctcagacggaggaatagctcaggcttcggagtccacagaccaccatcacccaggcacctgaatacactcacaacccttctaggggcactgctttgctgacgcactgtttcgtgagcttgcaaatcaagagaactgtcctgggcctccagcttcccttcccccagaactggcgggcagggcaggctttccagctggttattcagaagcaagcccagatgccccaccggaggtgggtggaggctgccctccgcagtctcgctctcctgcatctctggggttcccctctctcctcttgagaacaagagatctggagtgagacaggcatccgtaaaatcccacgatcgtgaggctttgggcaaagcacttgacccttctgaaagtatctttcttgtggaaaatgacagtattcataatggtggcaataataaacacatttagagtgttttctctgtgctgagcagttctgatttgcatatatttgcctctcttggtcctcccaacaactctctgagttaggtacttttattttcccagttgtcttatgagaagccggagcacagagaggttgagtggcatgtcctgatacatcgtggtaccgtgcgaaggggtaaatgtgatgggaaagtgcctggcagggcgagcacctagtagctattagtgatatagatgtcccaaactcaactcatgatggttcgactgacaatatttcaactttatgatgagtatctatctatcatctatctatctatctatctatctatctatctatctatctatctatctatcatctactttatctatctatctcacacacactatatatataacatatttacaatgtttagggtattttattttggtaccaattttccaggactatatatctatatttcatattttggatatcttgtcctattcctcgatgacttacattgctttgctaaacgttttctccttggaaatatgctgttctttgtttctccctcacaataagtggagcacagcgtttctggagtcaggagcgattttggccccgaaggggcatttggaaatgcctgcatgcagttttgatagtcacggttcagctttggggggcgtgcactggtatccggtgggtagaggctggggacgctgctacataccctgcaatgccaaggaccgcccccttcccccagcgaagaattgtctgctttgctgagggtcgctagtgctgatattgaggggccctgctctagtgcctggacttggggatgttctcctcgtgtttgtagccaggtgtcacctagggatctgcatttctgaaaagcacgtgagtaaattcgtctgtggtggtgaaatagcgcaagccctctgcctgggctcccctctggctcaccctggccatatgcataagccctggctccgtgtctgagaagtgaggggtggagggaaggaccataatagattccttgcgtggagctcctgtgaagattagaagggtgtggcccatgtgttgtataactgggtggctggtgcacagcagctgaggaatagagataagctgttagtataagcagtaaataaaatggaccatacattagcagtagtaatacctaatatttttgtagcgcctaccttatgccagccattgctctgaatgcttctctgtgttaactcacagcttccttatcagaacccgatgaggcaggtattttttttctttttttttttttgaggcgaagtctggctctgtcgcccaggctggagtgcagtggcgccatttcggctcactgcaagctccgtctcccgggttcacaccattctcctgcctcagtctcccgagtagctgggactacaggcgcctgccaccacgcccggctaattttttgtatttttggtagagacggggtttccccgtgttagccaggatggtctcgatctcctgacctcgtgatccgcccgccttggcctcccaaagtgctgggattacaggcgtgagccaccgggcccggccgaggcaggtatttttattgtccccattttacagatgcagaacctgagcccagggaacttaaactcctcacttaagatcatgctatggattgaaatgtgtccttccaaaattcgtgttggattcgtgttgaagccctaacgtgcaatatgactgcatttggaaatgtggcctctaaggaatcaaggctaaatgaaatcagaagggtggaccttgatctgatagaattagtgtcattataaaaagagacaccaaagagctctctctgtctctctctcaaccgtgtgaggacacagcaagaaggcagctgttggctagccagaaagagtggtctcaccagaaatgcatcggccagaaccttgatattggacttccagcctccagaactatgagaaaacaaaaatgactgttgtttaagccacctagtctgtggtgttttggttaccacagcccaagctgactaatacagatcatcttctagtaagtgggagaatgaggacttaaccctcgcaaactcaagtccagagtttagacttttaacttttctattttcatactttctactgtctcttctgctgtataagtgatgttatagttttatgaaatatttatatgtaatataatagaacatggaatagaaaatatttcctgcatattcattcttgcaatgagaaaattataactaggcaaggaatatatatggtacaatctaaagtgaggattaggccgggcgctgtggctcatgcctgtaatcccagcagtttgggaggctgaggtgggtggatcacttgaggtcaggtgtttgagaccatcctggccaacatggcgcaaccctgtctctactaaaaatacaaaaattagccagatgtggaggcacaatgcctgtaatcccagctacttgggaggctgaggcaggagaatcgcttgaacccaggaagcggaggttgcagtgagccgagatcacaccgctgcactccagcctgagcgacagaatgaaactctctcaataagtaaataaataaatcaaataaagtgaggattgaacaattgaagggtcactgataatcactgtaaggatttagcgccagggcttggcagtactcaggtgagtaaacgttagttattgctaatattattcatttatcttattattgttataattgagttagttctgtgttctgatccatgagtgaattggcctcctggaagctgccctcaaatccctcctcttttacacagtgattgatggtccatgtcgcctccttgtagttacagattaataataggccctcctcctggaaacaggccaaacgccaaaccccatgcaagctggcctggagaaagcacttctgaaacttcatcaccagcaggcagctagacgactgttgaatgggagggggggtggttttgaagggtggaatggtgacagaattagtcaccaagtaaacaagcaacaccttcgatcaatgcaatggaatgtaggtaacccaggggccctcctcactgctcagctgagggtgacgccaacatggccaggctggcacacccagcagaaccagccctctgcccccaacatcagtaaagaccttgcaggaggaaagaacaaccccgctttgcctgccccacagtcctgcagctccatgtgtgtgcccgcacagtgctaggaacacggcagctattatcaggagtgccaggtacagtgctacaggttgcctcctgtacaaggggacacagggaactgaaatccagtcctcactgaactgcccaagccctgattcctggtatgggactttgtgggtccaggggcaggggtgccttgatcaaaatcaccttggatgttttagggctgcttggtgattgatgttttgctttcggagtacttaattatgtttgcacaaacggatggtaatcctaaaaatcttagagctcgctctcatagtcttattattgcaccaaacattgttaagtgcatgataatcgcaggtaattttaattggaggcttactatgtgccaggcagcaccagggtgagcatagcaggacacaaaatataggaaggcaaccatctctggtgcagaatcggcagcagagagtgagcgcctccctgcattttatcccccaggtgctcactggcttcacccttgccctgaccctggtgccaggcacttcacacacattgtctccttttcccttgcagagtcccattattccctgattgcacagataaagaaaccaaggctgagcaatgccatcccctcatctcacgaacgtcacctccatgagggtaggcaccttactagtcctacttgcccaagagtagcagtcagaaagctacggggaggcacacctggggtttgaacctgggtccacgtgactcaggcactcaaatcctgaactgcttcagggcagggcacttggcttgaagagaagctgcagacacagagacaatcaagtcacatctaatactccagcaggacagatgagcctgcaaggtgcaaaggtacccccgcccccaacccaaagcctttttcaattcctctccctccacatctcttgtcatggtaaagcaggcagaatccatgggctttaacgggcccattgcttttcccaaagctcatgcctttttcctaaaaacaaaacccttctgggttccagaactctttggaaaaaaagaatcttctgtgatttgggacattggtttgttcccccaccctcacttaaatgagaaactactttagcatgccccgccccgtctgttgtctttatttaggaggaagcaccctctacataccctgagtatatacacccagggcctgaagctgctgtgatcagctcaggatccccaggaggctgaggcggatcaggccctggactccgggggaacaatgtaagggacaccaaaaagctcagccatggagatgaatagtattttaacatgaaatttgtgaaaatcaaaattaccgctgttcctgatcttatctttctgtaacatgttcatagtttgttcatcacgggtgtcttgccattaattctgacttttaaaaatgttgtgttaacataccgtttatctccatgactgagttttttggcatcccttacatttcgtgcccaaggtgagagtctcactggctgcaccctcatcccaggcccgactggactccagttccacagcatcctttccatgagacctggaaccagatgcagctccctcttcacccagcttcatgttcctagttgtaaaatggagacgatggtaacagcgaaaacaagaaccacagctaagagttactaagtgcacaggtatttacgggcagtagagtcctctcagccctttgatctcagtactgttattaggttcactttacagatgaggaaactgaggcccagagggctgagggaacctgctccagggcacccagccagcccagggtggagctggggctggcatctggcggtgtggctgcagcgcacccgcattctaatcgcaatgactcttccaggcaggaaactggttcagagggagatgtaaacagcaggggtcctgaagccaggatttgaatcagcagctgcctcatagggtggtcttgagcgttaaataagattcacaaaaggcactccacaagtcctttttcttgtcctcccacttctttaggcaatgcctgaggtgaaggctcagattccactcggctatggggcattcttgccctgacggatccccaaatcacacagcctatccctccatccagtgacttctccccatgtcctgtgcttgaaatgaccctcaatagttccaccaaataggagttatttatgtggctatgcgcctaacactgaccacattgtcatttgctccttgtaaaactaaaaactttgagatgagtgctatctttgggtccatttcacagatagtggaactgaggcttacacatatccaaggccacacagtgaacagaaggcagagctgggatcaaacttgaccctgtctgacccctggcctctatatgacaccgtctaccacaaacagcaaaccctccagccatgcctaaaggatctgaaagcagttacctgctgagcccctgtgggagtatcttcagtcccctcgtgtcacccggagctgctcctgcacagggtcctgggtctccagtgcgtgctgcccagtgcctggctgtcggtggagcctggctccctgcactttgcttccttgtgcagagcctgctggctgaatacacagagcagggcaaacacaagcctgggtggagtcctcccttctccccggaccatcctgcagaaacaggttctcttcctgatgtggggctgccctcccaactccaataaaaactgagcacctgactcctctcgcattaatgcctccctggcaccccaagtattctacccagt

SEQ ID NO: 1320 - DNA, 3094 bp, Homo sapiens
gggagtgttgagggggcctgaagggttccgctcctcccacccagggaaccgccatgccactagtgggctgtcctggagactcggggagaaagcacacaggctgtcgggaaaggtgggtcgcaggcgggcagggcagccctgctgtactgatgggcaggcgctgggtgggtggaaggcaaagccatcaggtcatccccctctctgtccctgcattgggccaaccaggtgtgtcaggaggatatttgaccattcctgagaggcacattctctctctctctctctctctccctctctctctctccctctctctctccctctctccctctctctccctctctctccctctctctccctctccctctctctctccctctccctctctcccccctccctctccctccctctccccctctccctctccctctctccccctccctctctctccctctctctccctctctctccccctctctctccctcctctctctgtcacacacatttgcacatcctgcagtgtgaatggagtatgaatgtgtgtggtaggcgacagctgtgtgtgtacgtccgggtgcgtgtgtgcgtgtgtacatgtgagcgtgtgtgcacgtgagttagagcctgagtgtcccctgcgtgggttagtgtgtgcgcccgcccggtgccctccgtcttgggagtctgggctgctgctccgcgggctctggagccggcgctccccacgagcccggactctccgccgcgcccgggagctgcgcaatcggctgctaagacgccggcgccaccggctgggccctgttctcccctctcttttctacagtcttacccgcagctgacagggttcgaaagagcatgaaacggaggagacgttacagcaacgtgtcagctgaaatgatgggcgtagacgcacgtcagcggcggaaatggtttctatcaaaatgaaagtgtttagagattttcctcaagtttcaaatgaggcgaatcccgttttccgcgatgctgcagcgcgcgggttttaaccgcagggtcacgcggaacgccgcgccgcgcgactgtgcctcggtctctgcgcccggctctccctccggtccgcaagaggaggaaggcccgcggcgtgccgaggtcagcggcgcggagccaccaggcgagacggtcacggacgcctgaaccgaggtcaccgaggccacggggccgggaggccctcagcagagcccgggggctccgcacctcaaggccggccaggaagaaacagcagcaggagcccagggcgccccggggagcccccgacacgcgggccgagcgcccagagcggcccaggccctcgcgaggagaccggcctccccagggcggggcttccgactcgggcgcccgtgagccccggaggcggcgcgaaggggcagagtccgcgtttctaaccagcccccgggtgggcggtggcccgcgcggcacggtgggcgcgagcgccgtgggctggggccggcctgggctttcagggcgagggctttccgcgccggccccagcccacccggccccgctgcgcgcccctcacgctgcagcctgggaacctgggccgggagctgcgggccgctccggggaagcgggcctgacctcccctccccaccgccgcccctgcggtgagatcctgcctgccggggcgcaggggcccgcggttgggctccgggagacggaagaggccccacagctcgggccccacgcagtggacgctgccacttaattttggcgtaattgatgtcaaggcgggtgcccgggcccccagtgaaatgcctcatgaactcgctgcgaggaacggcgctccacgcggtgcacggtggccaatcagagctgccgcttctgatggaggctgagccggctggggaggcgtcttggccaagaaccagccccagcctcgctcagggccccaacccgcagaccatgtaattaagctgcgttctgcagccagggcaaggtgcggaggggcctgtttctagcattggggaggaggaagtggggaggagggagcggggaggaaggagtggggaggagggagcggggaggaaggaggagtggggaggagggagcggggaggagggagcggggaggaaggagtggggaggagggagcggggaggaaggaggagtggggaggagggagcggggaggaaggaggaaggagcggggagcagaggagcagagcgggagggaggatcgtcgtgcagggggcctttgtggatgaggctgggatgtccctgcccctccgttccctccagagtctcagctctgaacatcttcccgcacctctgaggagccaggcctggaaaccctctaaaatagatttttctgcctcaagacagaagatgggcgttccaggcagagaagagctgcccagtcacgtgctctgctccacctggtcagagacccttgacctttagaagactggacctgagggcgtggctggtggacctgagggcgtggatggtggacctggccacccagctgtagctttttgggttcctgtggtcccatttcttgggtcaatctcacacctggcagctcccaggaagacacccccaggcccctcacactcctgggggcagctggaattggcttcagggcgggaccaggggccccatgggtgtttggaatccctgatctgggtcaggcaccggcagcaggattccagcctggcctggactctggtgtgtcccgtttgaagaaaccccgccctgtgaaagttcaagtttagcatccaatgacccatttaagaggtttgctgagccacgtcacaggagggtctgggtgcaaacggaggtggcaacacacagagcgagccttgagcacccaggttacccccaggacctccagtctggcttgggggctcctgctgtcctgtggagcagccccctgggatcagggacggggctgagctggagagtgtgcaggattgattaatgatgtctgccacggtcaggccaactgctgtgtttctggggcccacaagctaaaaatggttggaaaaaaatcaaaacattaatatttgtgacatatgagaatgctatgaaagtcaactttgctatccataaataaagttttattgacat

SEQ ID NO: 1321 - DNA, 6827 bp, Homo sapiens
gaaagtgtaagtgttcttttttaaaaaattgtcatgagtacatacagggtgttgctatttatggggtccatgagatattttgatacaggcatccaatgtgtaataatcacaacaggggaaacggggtgaagccgctatgtttgtgataattttttagagcagccataaaaatatatgtaaataggacctagttagataacatatatttttggcttctgctctgtagaaactcacacatgatttggggagttgtgaaggcctgatttgattttgtttgtttgtttgcttgcttgcttgcttttgagcctggtgtgccgggcgggcaggtgtttcattgaacctggccccttgcttgttcaagtgttgagtgagggcagtctccaggttccgggagcttccgagtgagcctcacgcctcacggctgcaggtcagaaagtgatttgtggcccagagacccccggacgtagcttctgcttttcagaatctgttcattcatttagccccaggggacctcatccctgaatgtccacaccgggcatcagacctggttgcagagtgggtggttccaggaggcagcagtgtagaccagtgaaggagcagccagggcctgagtgaagctggggcagcagaagcagctttcgatattttttttctgctgagtcttgccagcttttagtttagaagttccttcctggggaagaaagtggccgcttaaatggcataaaaaataatgcaccaggcaggggacccttgagaccctggggctgggctctggctgggggcctcacacggaggaggagggatgagactctcaaggaggccaaggtcccaggtcctgggctatcggaggctccttggggcctctgccttccccaggagcaagcaaggaaggaatgtacagcagcagggcgtgggcacagggcagccccaggaacaatggggatagtcacgtggccccagcctccacctcgctggcactcctcttgtcccaggacaagcccagcctgctgcccgctgcctgcttctcctgcattggagggctccaggcccagaatagctgctcggagccagcatttgcatccacgtctcctccacacgttagaaaacctggactttgttttgtaactgctggttccgctcagcaaatagaattgtacctaactgtggaggggccctacacagtggcccggcccgggagacccacgagggcctcaggagcatggcttctcccgtctgcctcctggtttctgtctctgaccatgtatctccaagccagtcagtcctgagtggccacagtggggatggggctgcaccaggggcctgccctgctgtgctggcctctgccagggctgggccctgcctgtgaaggagccctgggttgggctcttttgtgcccactctcaggtggggttgcgggaggcctgcttggccccatggggatcagtgtgatgagcatgactggaggatgtgcgggcttaggatgagcagagggaccctacagagccacgaccccaggcccagggcccctgttggccccaaagcgagtgtggtggccgtcgttgggaccccaacagggggtggcactggcgtgaggtctgacacttgccaaattcctgcgagctgacccctcgatggggcttgcactctaattctgccccagggaagcccaaggtcaggattagcatcccccctgcttaagggacagctgaggccagggtggggctggggtggaatggcgggctgcatgcaggaagcccatggagcccagatctgctccaggtcacaaccctgtacctggcttggggtccacactccccagacacagatggtggcatgttcccctcggactgtccacctgttgttcggccaagccctgaccctcacagcaggctgctgagttcaaggatgcccctgggcagccaggctgggacccttgcccactccctggacgcacatccgcccgccgctgggttcacaggggagggattagaaacctctcaacggaacgtcgacgaggcgagtggggtggggatgggggtgggaaggggacaggccctcccccacacgtggggagatgcatggctgtgaggtgctgcctccgcctctgaggctggcgataggctggattcagacacagctcgagccgctcaccctccacgtcctgcttaggaggagtgcggggccggctaaatccccaatgcccagggcccaggggcatcccatccatagcctcaaggtccctggcttcccctggggatggggctgtcgcacctgtgtcctcccagttccgaggtaccattgatacacacacaggggtccctgggggagtttcctaactcctcttcctctgaaggccaggcctgggagaatgaattctccaagcacccaccctcactgtaccacggcaggttagagaatgcggacagagctgcttggctgcacaccttgggggggcgtcaccctctttttagcctcagtttccccatctgtgcagtgggtaccagagaggactttacacagaggctgtgcattcccttttttttaattttttttttttgagtcagagtctcgctctgtcgcccaagttggagtgcagtggcgcgatctcggctcactacaacctccgcctcctgggttccagcgattctcctgcctcagcctcctgagtagctgggattacaggcgcacatcaccatgcccggctaattttttgtatttttagtagagacagggtttccccatgttggccaggctggtctcgaactcctgacttcatgatccacctgccttggcctcccagagtgctgggattacaggcatgagcgaccgtgccctgactgaggctgtgcattccctaacagagggggacgtctggctgcccccacaaaacagcagctctgagcatgtctaaggtcagcccctccctgctttccttttctccctgatcaaattcatgtggcttccactcagccccttcttccggctcttacttaggaatgcagatctaccccaaaccccaacacacactggaaccctcaaggtcccatcctactgaaagccaggtagccggtgcagtgagcaatggacagatggatggatgatggatggtggatggatgatgggtagatggaggaatgcatgatggatgaatgaatgaatagattaatggatgaattgagtagatagatgaattgatggatggatgatggatggataaatgaatggatgatggatgaatagattaatagatgaatgaatgagtggatggatggatagatgggtgaatgcatggatggatcatggatgatggatggatgacagatgcatggaaggatagatgaatgaaagaatgggtgaatggattaatagatgaatgaatgagtgggtggatggatagatgggtgaatgcatggatggaacatggatgatggatggatgacagatgcatggaaggatagatgaatgaaagaatgggtgaatggattaatagatgaatgaatgagtgggtggatggatagatgggtgaatgcatggatggatcatggatgatggatggatgacagatgcatggaaggatagatgaatgaatgaatgggtgaatgaattaatggatggatgaatggatgacaggctctccatgagccgctctgctctcctccatggcctcctgctcactggcccctatatctcacatcctacttccagtttaatggagacaagagtgtcctccccaacccaagttctcacccccatcccttcctccctcagacccacctggaagagctgcttctcttctcttgtagaagtctcccatcccaaggaggtgcctggtctttcccctcaggaaggcacctggtccttcttcctcccttccctcctgggagacatctggcccttcacctccccctgccccttcacctcctatcaaggcagctccctcagtattttctgcagaccttgtttgtctcctgtgacgttcataccctcccgttcccacagacattcttccatgtccagcccagacagaaggaggtccccccctgccggatggatgattgaggctgcctgtgtgtacacgtatgactgagcaatggacggaggtgtctgtgtgcagcaggcatgtggcacgacctcggaagagggaacaagacaagatgtcccccaaggtgcccatgaggaccctccctgggcagctggactccagcccaccttgggctgcagtgtgcattgggggtggggccaaagacccctccacatagagaaggcagccaaagggaggagggagtggtcagaaaaggttgtctcagccagggagcggctccaccctctcctgaggacgcctgacctcagacgtcagctcccgttagagacccccgtataccccctgcctagagccaaactctgagagtctctggatggactgaggggtgggacaaggaaaaaaaggaaggagggagggagagaagcagcaaggaggggtcgcctggcccggctcccccagtgaggaaaggggctgtggcacagagattccatctgcagggctgggggcagccgagaatggcacctccaacgcccacggcaggggcccacccgcctgcctcctccgggaccaccgggcctggctcctctcacagactctttgagagcgtatttgtgaaacgtagcatattgtgggtgattagatttaaatttcaatacactttgttaaaaatagagttggctctcgccaagaggaggccgcaggaaggggctctcaacggctcgtctttggaatattaatagtatggaaatgttattagaataatttttcatcatgaataataaattaatggaataattcggcagcgccacgtgacataccctgctaagaggggctttgttttaacagaatggggagggtgggtttggggtgtgggggagggcagagctgggggagggtccgcccagggcaggcggggttgggtggaagtgagtgaggtgcctgaagagatgaaggctccggaggcatttggggaggaggacagagacctgggaccaagtcctcaggcacttttagcttcatgtctcagccagggttctggccctggccggctccttcccacagaaaagctgggaagagatcttggtaggtgtccggccccacacaccatcctgctgggggtggctgggttggacttcaccatccccacagccctgcagcctcccctcctgcatctttctccttggtaaatgccaggaacctcaaaagcacccagaggcccagagaaattgagcacacaggggtggggaattcaagagcaggagctgtttctagggccccaggggcagggccagggtctcctggtcatttctgtgctcgggacccctgctgcacctgagctcactgtggaaactgcctgagggggccacacggagctgatggggacaagcatgcagggtgggcacccttgtgggctcagcttggtccagggtgtccactgggggacggggagggagatggagcaccagggaagaagcgtctcttcatgtggtcagcgccccctccttctccccactccctccttttgcctcccttcctgctgctgcctgcacggtgagaacagagatgagatggcccctgcccgggagcagtcagcggcaccacaaccctcccaggccaacccagctcctgacagagagggagggaggcagcctggggctgggggccctggcagcagtggcacacggagtgtgcacatggatcctagtcagccttttgcagggcgctgaagccagtgggggcccccagggaggttttgggggagtgttgagggggcctgaagggttccgctcctcccacccagggaaccgccatgccactagtgggctgtcctggagactcggggagaaagcacacaggctgtcgggaaaggtgggtcgcaggcgggcagggcagccctgctgtactgatgggcaggcgctgggtgggtggaaggcaaagccatcaggtcatccccctctctgtccctgcattgggccaaccaggtgtgtcaggaggatatttgaccattcctgagaggcacattctctctctctctctctctctccctctctctctctccctctctctctccctctctccctctctctccctctctctccctctctctccctctccctctctctctccctctccctctctcccccctccctctccctccctctccccctctccctctccctctctccccctccctctctctccctctctctccctctctctccccctctctctccctcctctctctgtcacacacatttgcacatcctgcagtgtgaatggagtatgaatgtgtgtggtaggcgacagctgtgtgtgtacgtccgggtgcgtgtgtgcgtgtgtacatgtgagcgtgtgtgcacgtgagttagagcctgagtgtcccctgcgtgggttagtgtgtgcgcccgcccggtgccctccgtcttgggagtctgggctgctgctccgcgggctctggagccggcgctccccacgagcccggactctccgccgcgcccgggagctgcgcaatcggctgctaagacgccggcgccaccggctgggccctgttctcccctctcttttctacagtcttacccgcagctgacagggttcgaaagagcatgaaacggaggagacgttacagcaacgtgtcagctgaaatgatgggcgtagacgcacgtcagcggcggaaatggtttctatcaaaatgaaagtgtttagagattttcctcaagtttcaaatgaggcgaatcccgttttccgcgatgctgcagcgcgcgggttttaaccgcagggtcac

SEQ ID NO: 1322 - DNA, 75689 bp, Homo sapiens
acatgataggggagctggaggaacctgccgtctccgccatcgagcgcccctccgagctggggttggacgctgccagtttgcacagcagcaggtgagcctggggggttgagggctgagcgggggtcccagccgatgaagcagccccgcaccttggccagcttctcgaacctcctctgggcagaggctgtggaggctgcgaagcggcggaggcgttgaccaggccagctgctcagcctttctggcctcagtttccacagctgtaaagtggggtctgtccacaacacgtgtggtctagcgacggccctgcggagtgggtctgtaactgcggactcacttgtcccgggctgttctgaaccggtggttcccccgccctcccaggagacagcacctgtggccggcagccgcccctgcagcggcccctggctcccaccgcgccctggccctgggggtgcccaaagaccggggtgtgctgtggcccgagtgagcaccctgtgggcgtcactgctgtccatgctgctgggattggggaagggaggtctggtggggcacagtgggcgcaccaggaggtcaggctgggtggggggagcgggagggagcccccgctgggtggtcttgggccagccagcttcttgcctgcagggcaatggtgctagtaactggaacaacccaccctgcctctcccagagacggcgcctcctcagtgctccccttccacaggacgtagggtcttctagagatcaaaacagggaggaggaaagaaatcctaccgcaggcccctgccccgaccctgggacccacactgtttggcttctagggacaacgcccaggccctgggatttgaagactccaccttttctttcgtgtgtatatgtgctctgtcaaaatgtgtatcacatgaagttgatcgttgtgaccattttcaggtgcacagcccaggggcattgtacacaaccgcggtgttgtgcagccgacgcccccatccaactccagaatgtttgtatcttcccaaactgaaactctgtccccagtaaccccggctcccctcctcccccacccgctggaaaccacgactccgccgcccacctctgcatttgactgctccaagtacctcaggaaatgacctcatgcggtctccgcacgttcgcgtccatcttgtttatttccagcgtttggcccgtgggagcgatgagcgcacctgttcagcccctgctttcagttctttcagggagttctcacgtggtcttcagaggttcccacacgctgcttcccacagcagctgcaccattgtacattccaacagcaacggacaagggctccaatctcttcgtattcttgcaaacatttactattttatgtggtttttttttcttttctttttttttttttttttttgagacggagtctcgctctgtcgcccaggctggagtgcagtggtgcgatctcggctcactgcaagctccacctcccgggttcccgccattctcctgcctcagccgcccgagtagctgggactacaggcgcccgctaccacgcccggctaattttttgtatttttattagagacggggtttcaccgtattagccaggatggtctcgatctcctgacctcgtgatccacccgcctcggcctcccaaagtgctgggattacaggcgtgcgctactgcccggtttgaaaaggcaattgaggtttctaaactcctactaaaggaaataattcctagagttgggctgcctaagagcttacagagcgataatggctcacctttcacagcgacagttacccgaaacacatcttcagccctaggaattcagtgccgccttgactcggcacggaggccacagtctttggggaaagtagaaagagctaatcaaactctaaaaaggactcttgctaaactatgccaagagacatcagaaacctggaggtctttattacctgtagccttattacgggttcgaatggcccctaagggaaatctgcatctcagcacttttgaaataatgtatagaaggcctttcttaactacagacctcctaatagacatagatactttcaagctacagaattatgtgatcaacttaggacaagtgcaaaacgcactccttgactatggaaatcagagactcccttcccccactgaggaagacaatctggttccaacccagctgggagactgggtcctattgcaaacttggaaggaaggatcctcagcagatcaactttccccccaagtggaggggactctatcaagttctccttagtaccccaactacagttaaacttctgggaataaacagctgggtccacttatctcaaattaaacctgtctcttataaagccccacaggccaacggaacacaagagactgatcccgtttattcccgtgagccagtcagtgacctctgattcctgttcctaagaaatgagagggatggggggcataaatacctggattggcattctacttttaggcacaagttggaatcatgcagagagtgatttatttactgagtaggcacagactttagcctgtctacataatcacataaacggttgggtatgtggagaattgccactttcctccacctctgggttgccctggcatagtcaactggccagcctaagtctgtggggattttacgttccagaccattacccaggctatgagagctttagagctcacgtctctgccattgatgagctgtcagtcagtcctctattggcttggttccaacagctgcccagttcttggaaagcctttctgtttagctagtttacttggaatgattttatttattttgctttgctattgtagaatatattgcggttgtactctttgtgtaggaatgcatgacaagctcactcaacactttcttcagttggacatttttttgttttttttttgtttttttttgagacggagtctttctctgtagcccaggctggagtgcagtggcatgatcttggctcactgcaacctccaccttctgggttcaagtgattctcctgcctcagcctcttgagtagctgggattacaggcgcacaccaccatgcctagctaattttgtatttttagtagagacggggtttctccatgttggtcaggctggtcttgaactcctgacctcagatgatccacccgcctcagccttccaaagtgctgggattacaggtgtgaaccaccatgcccatcctgtttttccttcttaaatgagacaagagggatagagaatggggctgtgtgtttcccttcccaacataaaagactggagggagctggagttgatacttcccttcctccaggttggttagactctgattaaactctggtacgttaaaaatagtttctcttgagggcagaggaagaacagaatgctctggcatatttcgaaagtgctacttctcccctccccttgtccaaagcacaaggggatttttctctggtatttacctgggggatctggtagagtttgtgcaggtaaaactcacagaagtgtggcctccaccctaagactgggccctggagtttttaactgtcaagcttggccacacagcctccagcaatctgccagtgacagtttaggttttcccaacctggcagtggttcccagggaggtgtctgctctgcagaattgggattctctgcatctgtctgtcgtctctacaacttttttgggcagtggtttgccctgtgacctcatcatctgttgaatataagaaatattattgactttcagtttgctcacgttttgttcttgtgaaaagattgattgtttccaagcttctcacacagtggactagaaattgattcatttcatttatcctttttgggtttgtggggttcttgaatttgtgacttgatgattttgattacttttagaaatttcctggctattaactctggagtattgcttcaacctcatgttctctcatctcctctctgggatccagttacaaatatattggtccttcttcctgaatcctttgtgtatcttaacctgtcacctgtattttccatttgtattatccatacttcattctgaatattttctactgacctattttccacttcactaattctctcttcagctgaatttgctattaaagccactaagtttataatttaagtgattttatttttcagtgctagaattttcatttggtttttctaggtttttttttttttttttgctgaaattctaaattccacctctatttctgcaaatgctgtaagcacagttttgttccagtctctgtctcgcgactccagtgtctggactggtagatcttctgcctatggtctctgctgctttcattcttgctgatttgttttttcaattgtctagaatttttattgtggactgaacattgtatttgtaaaattattttgtagaaatcatttgaggtctattttattttcctccagagagggtttatgtttgcatctgcgagacatgggggcactaggggtcctggatcatcttactctagtttcagggattgaaatcatttcaagatgattacagtttaggttttcctaccctggcagtggtgcaaaaggccctgagttgctgcaagagccggtctccttctatccacccctatgtctagggtgcggttatttgttgtcccaactcaaaatggtgggggtcggggggatgttcgccaactccccactctcaggtgggctgaatctctcgctgtctggctcctcagtgggctgtgagctatctgaagcagcaaatgctttgggggaaaagtgagcgtcccgaaggcttttttcactctggatctttgtctttctgggattttgtttgtttgcattccaagcaaatatttttaacattttgctcagcttttgtagtcaccatcagaaaagtgatgggtccagattaactagtccctaataaccagaaactggaagtctgatggttgttttcagtcttgaacaacattgattctgcggtgaccagtttagagttcatgcaatagaccttcctcccccttgtaaaatcatcactatttcagctaatacttagagtgacctcctggtgactcatcctcagccccctttgccggttcttcttttccccgacattttcattctggagggcttgggattcagtcctttggcctttttcctagctgtgtctgccccctcggggatctcatccaatacccttcccacagcctacccagaccccagtgctgaactccagactcacggattcagcggagcgcagaatgtcagatgtgtgagggccgcctccgatgcagcgcgttccagatggagctgcggcctcccccagacccgcccacccccacccccagattctgttgagggcaaatcatgcttcctcgcagctcacaccctgttggttctccctcccacgttcatctggaatgcggccgctccccacctcttcccgcctgccctcagtcagcacagcagccttctaatggcttctgccctcccatcatccccagaccctccctttcacacagcagctgtgaggtcctcctcaggcagggtcaggtcacgcctctccctctcagagtcctgcctcagcccctcccctgtcatcaacaaagactagactgtgaatggccccatctgcctcctgcctcccgagctcacagcctctgaggtcccggatgggaaatcccaccaggcagtctgtggacgccgcactgcaggcgagtggggtctatcttttcaaagctgatgcccacgcccagagagggtgtcttccatgagagacgtggcctggcagctgctgctgtgggccctgggcccggggacacacccggccctcattgaagacaggaggcatcccgctgggggagtcagatgagatgtccagccccacgtcacctccctgtgctcggccgtgctccgtgaatggcctggtgggtttctgtgtgtggagagctgggtgggcttctagggtcttgactacggggctggatgtagagtactctagagaggctggggatgagatgaggcagctgcaggtggcccctcctcaccgcctgaggacgcgggaccacgccaggcttttctgggcagggtgcccctggctgtgtggcaacagatatgcacagaaatgccacatgggctcctgaggcagcctcatgtctccactggtgggtggtgtgggagaggggacctgagattttgcctggctccttgctatttgggggacgggtgtgcctctggggtcccagctgtgaaccaggttgtttcacctggggtggggtcgggcttggctctgtccccgggtcctgggctttcctgggctcccactcactgccctctgggcagctgggcctccccacatccctggcgcgctggggcagccccatcttccttcctgctgctcaagcgagagcctcgccaccactctgagtgccttcgctcacgctcatccagtgcatttgaaatccccgtgctccaccttcccgacacccagagtcagccccatcacaggtctcatctgcacagggctccctgcctttccctgtctccacctcccccacccctgcccagtcagccgcatcacaggtcccatctgcacagggctccctgcctctccctgcctctccctgcctctccctgcctctccctgcctctccctgcctctccctgcctccacctccccccgccccgcccaggcctgcagctcctctcacccggtgctccacccctgcatctgggctgctggggcccccgtggccatgacagatgccgcagaggcgtcacatcctttctgggtgtgatggcctcggcttctgctcgctcactgcccggcatctccagtccagcttctcctgcagcatggagagaggccacgtggagggtgtgcccagcccatggcccacccaaggtcccctgtgtattggtgaccctgcttggaccttgcaacccagcccagccccacgggatgcagccacgaggtcaacccagccacacctcatgaagcggacacggccaccccgacccttctctagtcctgcacccagagttgtgactgtaaagtgggggttgttttaagccaccaagctctggggtagtttgctccaggcagcaggtgactgagacactgccctgtgggactccccatttctgcactcgctcccctgtatgggggctcctggatcatgccagggtcacgtctgataaacccaatgttagttgaaagcctccagatgaaaggcactcagtgcactccgcctcctgaatatcattgttcggcctcccggccttcaccatgtgcagacgctgacgtcagcacattcgacaaagtccccaattcccttgctctgtttctaaggccccgccacccccacgctgtggctgcgcttccttgtcctcatccttgtccacctgtgttctttccaggtgccctgagtggactggaggggcacagggcagcctggcacctgctgagcccttgctggggccatgctgtcctgagcccctgctgagcaccttatggggacatgagtgggggctcagtctgggaaggaggaggggaggcctggggagatggtctgactagctctgcccagcccctcggtgctgtctggggacaggctggggtccagggcctccccagatgatgggaccagtgtctccagggctctgcaggctggtcggggcggctgacctgggcatttcttcttctggctgccgggaggcagcaaggccccaggtttgcatctcagtggccaagtctgggcgaggcttttcggggagcaggggtgcagcggccaagtgtgtctttggccactctggggccacatcaacgggtcctggggtccctgaagcacccgggaggcagccaggagggcgccagtgctgggctgtgcagggtgggcctgaagaagggggtggtgcctggcggtgatggagtgggcccgtcccatcccccaggccggcagccctgcctcaggagagccctcagtgggctgcagaggggcctcccacggtgagagaggacggggagggactggagtgtggttcatgtggtggcctgctggtgcagggctgggctccatgttggcagggcttgcgggggcggtgctgggcttcacagtggcaggacttgcagagggggcctgggctccatggtggcagggctggtgcagggctgggctccacagtggcagggctggggggtctgtgcccacaaggccacatcaggcacaggggaccagcccccaggacagaggtcaaggcctggattttgtggcccaacctggacccctaactctctccttgccccacagtgagtaaaccgaggtgcagtcatggcgcctgcctcctgccgtgtgtttaggtgaatgaggtcaggccgggtactcacctgtgcatccccgctgctgggaccacagcaggtgcacccacggaccccagccccactccgaccgcctgtgtcctcaccctctgcgggctgaccctttccccctctggccagtggaggtgggaaggctctgagggcccctgagcccaggttccctctctgtggcccttagccctggccacagcactcggaacttctaaccgagccctgccgccatagcacacggtccgtggtgcagtcacctgacactgcaccagggcgtgatgtccacaggcaggccatgccccggctccacacagcggccccggactggagtgccccccgcagagacagcgggcaggaggccgtccttcggggccaccactgtgaccatgagatgcccagccctagagggtcaagggtccgtctgagctgcccgagaggtcctctgggctgagcagggagtgcacaggtggtggccgacgcctgctgctgagagcgcagctctgcggtgttgatgtggaagcagctgagccctggggcatgggctccaccagggccctcacggcctgcgagactcagggctggggactgggtgctgccatgtggtggccctgctgtcagctgcagtccccagctctgacctgcagagtctcactgtctcctttcggcgtttgcggagttggtgcgtgtgccctggccgtgctcggcaagggttcctcccggataaggtggaacccgatttggggtgcgctggtatcactgtcgcaatgatgcagtgtcgtcccgtctgggaacaaggcatcttgccatttatttaggtcttgaatttttctcttcaatgccttgtggtttcagaatgcggcttttccacagagtttgtgagattttcctatttgtcccacctgttcttgctgcctcttctcttgtatcgtttgggactaacggacctttcacatgactctgtgcttactgtcactacccgcttgtttgatactcccttccttccttccttcctttctttcttttactttctttgtctctttgtttctttttcttttcacagtcttgctctgtcactcaggctggagtgcagtggtgcaatctcggctcactgcaacctctgccttctgggttaaagcaattctcctgcctcagcctcccgagtagctgggattacaggcatgagccaccatgcccggctaatttttgtatttttagtagagacggcgttttgccatgttggccaggctggtctcaaactcccgacctcaggtgatctgcccgcctcggcctcccaaagtgctgggtttacaggtgtgagccaccgcacctggccctttggcttacgtcttagtggccaccctcttcagtaggtaggcttctggtacgtgcttccagatcaccaaggcgtagctctaaagagcaccatgagttcataacagcataagatccgctcgccgcccacccgctcgccacccacccgctcgccactcacccgcccgcccacccgcctgcttgccctttgtactatcgttgtcagacgttttactaaatccacatatgttataaaccccacagtgtattatgaatacgtttgctttaacaggcgattatctttcaaaatttgaaaagtaataaaaacagcatttttttttttaaagagacagctctcaccgtgttgcccagcctaaactgaactcctgggctcaagtgatcctcccacctcggcctcccaaagtgctgggattacaggcgtgagcaaacacgcccagccagaaaaacagcatttttatcatccacatattttccctatctagccactttctttgtctgtgtagactcatctggtgtcattttccttctgcctgaataactttgatgtttcttgtaccgcacgtctgctggtgataaattctctcggccttttgttgaaaaaaatctttatttgcctacatttgtgaggatatttttcccgatgtagagttttagcttgacaggtattctcttctttcagtcctttaaatgtgctaacgcgtcgtctgtctcccagctcacgacgtttcacacgatgtcggctgtaattcctgtctctctatgtaacatgcctgttttctttgactgcttttaagatttttctgtgtcactggttttctacagttttattacaatggccgtgccgtggtttctttctgtttattctgcttggagttcatggagcttgtctagatttttgtccaattgaaaaactttattaaacattttttcttgatccctccaccacattagctgtgtgcagcatattgtggatttttttttttttttttgagatggagttttgctctgtctcccaagctgggatgcagtggtgcgatctcagctcactgcagccttcacctcccgggttcagtgattctcctgcctcagcctcttgagtagctggggctacaggcactgccactaggcctggctaatttttttgtagttttggtagagatggggttttgccatgttggccagcctgatctcgaactcctgacctcaattgatctgcccgccttggcctccccagatgctgggattacgggcatgaggcagcacgcccagccattggtcttccagtcttttttccctcactgggcttcattttgaatatttgctattgctatgtcttcacattccttaaaaaatgtcattggatgttattcctgtccatcgtgtttcatttccgatgtatttttcgcctctgaaattgcgtttaggttcctaaagatctgtcattgcactcttcagcacgcttatgttttcctctgtgtccttgaaaatgtgggccctagttgtgactgcggctttaatgtccttgtctgctgatgccatcgccgccgtcctttctgggtctgtttctgttgattcttttttctcctgatcctgggtcatacttccccctttgttgcatccttggtaatttttggctgcacgcttccttgtgagtgctacattgttaggtgccaggttttgttgtaaccctttagagagtgttgggcttagtcctggtatgtggtgaagctgctgggaacccgatgaccctttccaggctggccttgggtgctggcaggccggatgcaggttatctcagcgccgtagcagttccctttggagggctctcccggtgacgctccctccctgtggggatgcagcttattcctggcctgtgtgagttccaggtgctgtccctgttccattccccagggctttctcccatcttgcagtctcatcccaggcacgtgcaagttggtacctttctaaggctttcggggagccctctgtggacctcggtgctccctctctgtgcagccctctgtctctggtcttctgccccgtggctatgccttctgtctcctcagctcagagagatgtctgggttctgtttgcagccccttctgagtcgcagcatgggagctgtcttcaggtggtgagccgggcaagtgtgggtgcccctcacttgctctctcaggggtcatggtcctgcactccagaccccgagtctgaaggctgctgtccacgtgtgttgtcggtttctagttgtttataggggaggggccctttcctagacgggcaccggagtctggctgcttctgtccctgttctctccactggccggggaccatgagaggctctggtggggccggtgatgtttattgagtggtgacgtttattgagcagtggaggggaccggctctgtaaagcctcagctctgtgcaagcactcagcggcctccttccctcctgtcctacagacggggacctgcgcctggagagcactctgcccgctgaggcagagcccgagtatgtgctgccgtctgtctgtctgcagagcttgggagctggtgtgtgagggggggtgtccagagtcctgggcggtgggtgctgggttctcctactgtgggaagacctcagggcaccaagcgtggggctccctgatgtccacgtgggccctgcccatcccccccatcactgagtgcagagtctccctctgggttcccggatggttccagacgatgtgggtgcaggcggtaggtctctctgcagtgtggatgggtccagacgacgtgggtgcaggtggtgggtccttctgcagtgtggatgattccagatgatgtgggcgcaggcggggaggagtgaggggagcacggcgcagggccatgctttctgagccctgactggacacagcattgtatggggcggagacctggacgtcttgagctgggtctcgccgacttccccttccacacatcccaagctgcacaggaggctggcccgggtcccgagggcccctggaagctgccccagccgcgttgctctcagacaggggcgtcctggctgcagcgggggccctgtgccgcctgcggtgtctgagaaggcgtgaacgcctggagaagcccagggacagagactgcgctgggagcagagtgaatgtgtctgttattgattttctccacgtggctcccacgttattgcacacgtgattttgtacttggctgagattaaatattaatacattgaacattaaaagagttttcagccctttaaacaattgtttatggcacaattaaaaggcaaatgaatgatgttttttaggagcaagtttgttggcctgagtcttatttgtgagggctggagctgaggggaggccccttgagggggcgcagagagggaagccgtgtggcatggccacttgcagtgggcgggcatctgctatttattgaggcaagatgagggggcaggctgccctggtgcccctgctccagacccgcaaataccaggagcagcccctgacgagagaccctagccccctagcccatccaccgttttgatgtaaaccaggtttccatgagcctcccatgcggctgcagggggtgggggaggtgggtcagcagagagcgagccaggtgggcagatggggtgtgggccgctgccctgtgcagggtgctcccctctccctggtgaatggaccgtcacctctgcttcctggcgccagctcctcgtctgtctgacttctctcgtgctgtgacctgcagggtcaggaccgcacggcctttcctctgagctggggttcagtcacttgcaactgaaggatcctgactgagccaaactagttaaagtaggaaaagggcctctggagttttcagttacgtgaaccgagaacggcttcaggcacagtggagtccaggtgccactgctggcacaaagcctgggtctccttccatccctcagctctgctgtgtcctgggctgacttgactctgaggcagtggaaccctcagcgtggcaggagctgccggcagccccggaggaaaacgagcacctcttcctccagcatctgctctctcttggcctggaaattccgtcctgagtctccttcccaggtctcagtcctggcggtttgagtggctgatcagaatctcccgcgccgcccacaggagacccagctgggtccggctggtcagtgccaagccctggacctgcgtggtggcgcccccaaaggctgctcggaaccggcccgtgcaggtggacctctgtctgttggttcccctcttccctcttcacaccctttaggtgcttcctgcaagtctgaaaggaggtgcaccctggcccgggggaggtttgcggggtgaacacttaatccggactagtttcaggagggcttcctggagggggctgcatttgggtggtgtcctgatggagcagagattgtctttttggaggaccgggtcccatgtagaggctgtgagctgcccacacactcttcatgccatgcctctcctttctgtcccctgccgctccctgggccagagctggacagattcttcctgagcacctggtccaacccggctgaggctggtcagtggcgtggttaactcggggctgccccggggggctcctgccatctcaggattcccagcacggacccctcccctgcctgcctcctttgctcctcgttgcctgctctaaagggagggatttgggcttagcatgtccacccgatgccacttcttttaactgtcaatacggtcggcatctgccaacctttcccacggtgactggcccctccttgggccactgtaggcagagtgatggggtcaactcgacaattgctttcactgtcaacccaagttctgcctaattagggggaacggcagcgtggctgagaaaatgagggtgtgtgtgtttgagcacacgtgaggccttccaacctgaaacaacagctgtgcccgcggccccggagcctagggggctgtgtagccccaggcccctgacccggcccccaccctccctggccccggggtcctgtggtcgcccaccacggtggcaccaccttgcggggatagcacagaacacgggcttctcagacccagagttttgaaattaggcagatttgagtgatttttaagaacggggtgggagatcggaactatttcacattttccaaatacagtgaggctctagagtgacgtgaaaactggatggtgcagcacggcgatgtcagttatgtgaacagccgccaccctcgtgcgggcaaaagcggctgatgggaaggactggatctgtggctgccactccgctgctccgtggcggtggggggcggtggccgcccagtccactctgcagtgcgggagctgggctccgcgagctcctggcccccacgccgctggacactggccagcccgggtcgaggtggatctagggtatggcagacagagagctggagcctctgggcctcctgtgggaggcaaaccctcacttctctgtagctggaagttcagcaagcgagaagttttacgaggccgtcaataagattgcatctttgttctgatgccgcggtgcctgcgtgatgatttaaaaccgctgagcccgacgtgctcacgggccaggcctcattgtcaaggcacaaggctctgtcgcttaatcacacaccatgatggcgaagctctgatgggattaagcttcccttctgcatctccacctcccttattcctctcagagggggcctgtgaggccaggggcctgtgaggccaagcgcctcacaatcccgctgcctttggggacatcgtcatggctccaggtgtctgcaactctgctgtgaagggttccctgggggagccatcctcccctgaacgggcaccgggtgtcttgggaccatcccactccagctatggcactcaggtgaaccccgagtgttttgtgctgtgactgggaacccgggcattggcaggtgatgtggttccagctgcagcttcccgtggtccttgggaaggcggcttcagggacggtgtaagttgtcagcgtcacccctgggaagggctccgaagcagaaggatgggggtgtctgtctccaggacccagattgtcctatcgggaagagttgaacgagggtggggagggtctcctggggggacaccagagccgagcctgaaggtgagcagagccttcgccctgggtgagtttcgttctggctgagcagtttctctgtggcccaagggacctgcattggttttttgagttgggttaggggcagagagggggagtgatggggctgtgggggtggaggtgggactttgtttcacttagttttataccctccacgatgttctttcccatcaaggacaggaacacaccacccacaaaatgaccttggagagacttttgttattttttagataggaaaaaacaaaaaaacaaaaaaatccccaaacccaataaccatttgagctactttgatggtggaggcagcgaatcccggggaaagccaggctcctaagccccagacgcccctgcctgctgaatcaggtccccgcccagtgctcagatggtcacgggctctgggatcctgcgggatttggaggaagaggccgtgctgcgtccgggctggctctgcccacaccccggcgagagatgctgacttcacattcacctctgtgaagatcacaggatttaagctgtcagcgtgggacgggcatgtgctttaaggatgattgcgccagcaaagccgccttcctgagccatgcttatgccaggctcctcctgtctctgagcaaatgctggccgcccggcccgggagcttccggaagctgtttgctccccgtgtgcaggaggaaatgtgtgtctgcagccatgtgtgtgggccgctgtctcctgctgcacccggccttcctcacggcaagagctctgtgctctgtgggctctggaaggaacgttccgggccggtgtgtcttgagagtgttgggcagctgccgccctgggggaaggaccctcactaggctggcccggggcaggagcaggaaggatgcggctcagctgccgcctagctctgtgtgccaagtccctgcagggaccctggaagccgagaggggcggctgggtggccacgcagcggggtgggaggtgaggggcctgaggaagccgcggtgccgcgttccctgggcagcgtcgctcacacacagggaggctcattcacgctcactcagcacggccgtgtcaaggcactgcaagtacactgacacgcagcttgcggtgggagggacggtggggtcctcggaccacccaacacagggccgcagactgggctttgacaacagaaattcagtgtcactgtgctggagccggaagtgggagacctgggtgctggaggtttgctgcgatcctggtgttccttggctcgagaaaccatcacttggcctctgccttcatcttctcacctttccacgcctctcccgtgcgtgtctgtgtccacgtttcccctaagggcacagtcacattgaattagggcccaccctactctagcctgaccttgtcttaactaatgaccctgcagtgaccttcctcccaagtaaggccacatctcaggcaccgggatgacgccttccacactagaattcttaagggacccaattcaacccctaagagggatgcctgagctgaggtctgtcgtggacaggctggagctctatcccccgggcctctctcctgcctggtgcctcccatttaaggagcaggttgaaggagctgagacccccccttgggcattgagcactcctgtcttggatacaggcttccccaatgctgccgcctctctccctgacctcaacctgcttccctgcactgagcctcacctttgaacgtccttccttccccagcgcgtggagccccgcacagctggggcagctcagccgagtgcaggcggtggcaggtcccaggggctggtgtcttgggtggggcctggtgtccgaggcctgcagatcagccctgctagccctgcccagtgcccaggctgcccctttgcctggttgggggttggtggggcagggagcctggtgggcttcactctgggtctaccaggaaggtggcactaggttaatcattattgccccgaccccctccgtatgggggggcaggaccagctcagaaattttagagtaccacgcaaaataagaacgttgggcttcttgctcaaaaatgaagaattctgggacagcagtggcggagcatgcagccttctgagcgcagacgtcgggacaccagggacgctggccgggagcgagggaggggctttaccgaggaatgggtttcctcctccagccttgttctggagatcacgcctgtgcaatctttttaaatacagaacagaaaaaaatgccagccccctgcagcctggtcacgagaatgccaggatctcagggcacctgctggctgaccttcgctgagatagaatttacacactgcacatgctcccatctgaaagggatgccccgcggccttcagcacattcacaacatcgcgcaaccattgccactcattccagaacttccaccaccccgaaaggagcccatcagagtctccccactgcccctgtcagctccttgctgtccctgtggacttgctggttctggacacttcatggaatcagaattggtgtgacacagggccttgtggcgtggactacggccctctgagcggtcttgacctgttcacctaaaaccagacgctgaaattaaccaggcccacctctccaggccagggcgggtgaattcccggggacccagcccttgcctgcaccaggagagtaagcgacttattaatagggtaatttatgcgggtgcctgcgcaccgggacggaccagcatctatcatggctgttttgcgtttcttgatttcacgatgtctgttgtgtgctcaggcccctcctctccaaggtcccagctgtccttgccctgttccctgtgaagagtgaagaaccaacgcgggcggggagtggaccggtggggagagggccggtggggagaggaccggtggggaggggccggtggagagggggccggtggggagggggccggcggggagtggtttggtggggaggaggctggtgaagtagcgtcaggtgcgggcctggcgtcggcgagtcaagtcgagctgatccagggccttctttctgcagcttcatcaggttctcaattagcggagggcgctggcggtggaggagggcattagccgtgcctgctctcgggctctgcctgccagagtgccctcatgtggcatgagattaaggctcagcctctttcctgacagcaggttttccatttttcttctccttcctcctctcctggcaacaaagtcctttgctgggctggggggtctccactctgatccacttccctccttcctgcctccctcccacgccctggaaaccccggcccatgactctttccctgagggggccgcccgcagcctctcccccatgggggctttgctctgggcaccccctttcccccggggcgggtggggcagcggccgggactcaggaagatggtggcccagtggggctctctccttgggtgtgtgggagcggagtcccctcgctcttctgggatagaacgctccgttgagctccccaaactgctcccgtgccgagctctgggggagggagtctgttcagagacggtgcagtcctaccttttagaaggtacgcctgcctttttaagcagctcagctctcaacaatgcacaagtggcttgagtagaagagctgctcctgctgggaggcgcaggaggctgagcgaggcccaccctgcaggggcgaggccacggtttgtgttatttcccatgatgactccaaacgcacccgagtcccccgggcctccgcgcctccgtgtgcaggtcccccgggcctccgcgcctccgtgtgcaggtcccccgggcctccgcgtctgtgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgtctgtgtgtgcaggtcccccgggcctccgcgcctccgtgtgcaggtcccccgggcctccgcgcctccgtgtgcaggtcccccgggcctccgcgtctccgtgtgcaggtcccccgggcctctgcgtctctgtgtgcaggctcaagtttgccaacgtccatgcacgtctcagcctctcagcctggactggacaactgggcttcgggaattcatttaaattctacccgctacacgccttccctggattcagggcggcgtccagtgcattcatcacgcgtgtgctgccgtgaaggtgcggggaccccccccaaaaggcttccttccctgtcctgcgtcctgcccacaaggcggtgctgctggcaccaggcctgacctggcgctgccagtgctccactgttttgagttattgaccaacaattcactctcgggtcccgaggggaactggcctgaggccactcaagcagaggctcaatgaggaaagataaatatttcatggtctgggtcggtgagagagggaaatcaatagcgcatcccatcctcagtacggcgcaggcctcccacccaaggcagcgagttgcatcctccgtgccgcgcgggccctcccacccgaggcagcgagttgcacttccgggcttgttctcttcctccctttaaggcaaggctgcaaactgccaggccgatggcccgtgctgggagcaggcaggtgtcctgactccgcctccagccggtgaatcagagccctgagattcaccaagggccccctgcccgggtcgtggaggcagagcctggggctgggagaggcccttcaggacccctctgtgggagccggacgcaggcctggggatgttggaggtgggagcgcttccaggccccttgtgtaggaccagaggctgctccgaccctgctcggggctctggagacagaagaacggcatgagtgtttcacaaatggtgcagacagttcacaggtcaagacaggggacaaaagtgaccacttttagttaaaaacaggtgactccgtcccaggacaagcacgatgctgtgttaggtcccgttagtccccttggaaagctgtcggctttccctggagaggacctcgttctgtccacgccactgccctgcgagcgagagggagtgcgagcggggcgtccacgcgctcccatgggggacctggggctgcttcccgcttcccgattttccttcagcgctgctcgtggcgtgccctttctcccgtggcgcagtcaccagcaggacgtgtgtcccgctcacgctttgggaaacacggccttgtagcaggagctgctctcggggttcagcatcgggggtggcagagcccagtgcctgctggggcattgccaggcatcgtggagctggacccagagccaggggtcccagctgctgctcctcaaggaccctgtggctcaggaaagccctcccattgctaacgtgtcacccgaagggcttggggacctccacgcaggatgggcttcaaaagtcagctcaggcggtgccctggcctcgggtgcgcggggagaccactggcctccctcatgccggctccctgctgactgtctcgtgagctcctggcagcccttctagaatgttctggcgtggctccctgctcacgtttctaaagcaactatcagcccatcctcaattaccgtgtctccaggaccacagacgacctggagcagcaagagtcagtgctggggccgggcgcggtggctcacgcctgtaatcccaacactttgggaggccgaggcaggcagatcacctgaggtcgggagttcgagaccagcctggccaatatggagaaaccctttctctactaaaaatacaaaattggccgggtgtggtggcgcatgcctgtaatcccagctactcgggaggctgaggcaggagaatcgcttgaacccgggaggtggaggttgcagtaagccgagatcgtgccactgcactccagcctgggcaacaagagtgaactccgtctcaaaaaaaaaaaataaataaagagtcagtgctgggacgagaggcaccggtaacatggccagtgttgcagccggaggcgggcagggctgacctgtccagggaccagcagagctcgggcaggaggtgaccctgagtcgggggagagggggcgtgggagcctggggctgggggaggagggaggatgtcactgtggatgaggctggttcccagcctcaggagccaggcccgggcccctccagctccacctgtgctcacctgggcaggtgatgccccatgctgagcctctgctctctggtccttagggtgggggtgcagttcatgccccatgggctgggtgaaagaataaacccccacccagtgggcacgtgcggcgggcacccagagtgcttgaagtttccttgtgaggctgctgctgactctggggagggacggtgtcgttggagtggggccacctggcttggcccgttgcccttggcagcaggaatacagctgccctgggggctcctctgccacacgggcactcaggggtgctggtcgttgggtccaggcagggtgggggcaagagccactgaggggccctttgtttgcatcttaggtgacgctgcagaggtgagtggccggggcatccagagcttccctgaatgactgggccacgacgatgaaggcgtcagggctgcagcctgctgggcgtgccccagccaagttttcaggacggcctctgcttctccttcggggaaggagcagccctactccctctgatggggctgcctgggagggttggatttgttgtttgtagggaaagactggggcggagagcagggtgctgtggcccctctcgtccctttctggttcctggggctgtccgcacagagcaggtggggacacgctggctggatttcatctggatcagaggagggtgagaggatggtctcctggtggggagtgcagagcctcagctctggagtgtggagaaggatccagcttgttgggtggtgtatggtcagaagtggggacctcggggcctcagatctggcctctgatcccaactctgttcccctcggagccacccttccctcatccatcaggagccagtagcagccccaggacagctgccgtgggataaataaaaggagccgccttcaggagctgcctgccgagtgtccacagaacgtagcgtcttcccagcactcagcgggtcctgatgggcctccttcccaccgccctcttccgagtgtggggagctcaacccctgacttggggtcccgggacattcagttttgtgtgtgatcagggaggcagcgcctgacccacagaaagcacctgctactggtggggtctcagatctgtgcacacctgtgtcccgggctcctcactgtccgggtggtcacactgtccctgcgctgctggacttgggggcttgggtgcagccagccttgtgctcctcagcctccctggtacaggaggactgtccatctgcctggcaggggcaaggccgtcttcagcggagagacctggaggccacgtggtctgctcagaagtacctgcatgcagtttgatgccctgctgcagcaatcttgaaattcttagtaattttatctttgaatgctcgctttgtaagtgcaatctaaggatggtggcgtgagcatgactgaaggaagctggagatggtcagggtgcgagtccactgcggagccagtaggtgccagtggttcgagaggccacgctttcccttgactcagagctggccccaagtgcagaaaggaggtggtgttgctctcagatgcccacacaaccaaggacacatcccccccgtctccctgggactcccatgtgagctggccacctgcactgcagatgacgatgtggaaggagagagaaagacaggagaccgcggcttttcctttcagtccttcgtacccaacagcaactgagagggcgtcccggcagggtatgaatggccagcaggacgctgaggctgcgtggcgtttccaccgtgctgcaggaacaagatgcacatcgtgcaggagccgcagagcacgcgtgcagaggtttcggtggctttgccccgcagctaacgtgtgcgtgtgtgccttgacttatatttgcattacttagaatgacattcaatagcaaatgaaagacagccggcaagtcaatagagagaatgcggaaggaaggagaaggctttgtttgtggctctgagggcacttttcctcctgcatttgcattttgcactgtgcagatttgcaccgtgcagccacccgggcctcctcgggtctggggctccatttccagcacccccacccagcgctgtgggcccctcccccacgcacctcccccactttggtggtgacagttggttgtggaggaacaatcgtcagtgatgggtgaactagctgtgtttcacgtggcctcctcatcactctgccaagcccctggggcaggcacattttggctgccatcgactctagaatgttctctggtgtctccagggggtgtgcagagctggtccctcccagcgaggagctctgctcacaggttcacaccccctgccctgttctccaagatgggaatgtctgatgagagccccagagaagaatcagccgctgggggtcggggaggtgttggactctcttgaaacaaaggaggcccaagcctggggtcacggggctgggggtgggggtggggtgggagggagtgggcagtgacctgagaacaggaagggaggtggaggtcttgggtcacgggtgatggatgatggaggaacaggcccaggaggccctgcttgctgggggcttctttcctcttgcgtagtcaccctgtggggggctctcaaactcacagagtttggccgtagggaagtgcaggggtggcctgggaggctgcaggctctgggacagcctggctcacacaggagatgggatggcgctgagaggagaccccggggcgcccagcgtctcaggctataaggagcagccactcattgtgacacccgatggtgaaatgctgcattattatttatggtgttgaataatcacagcacaatcattgcaggccacagggcagaaagtgctaatgtagtttaaaaacagtacatttgaatctggacactggcaagaaaataggcaaaataaatacttttgtccacccctccctaccctcttttggtgacttggggtggcctgggtcggtgctcagcccagggtcccgcggccagagccaaccatggcgcgcctggtctcctccagataaacgcgcgcccacgtctctgctgggctttggaattagctcaatactcattcagacgcagagtgcgtgtgccctgccaggacagacgtcattgctgtgcggtgcttgagtgccatcaataagccacagaagagaaatccggaaacaagggacgcgcagcgtgattccgtgccacggcgtcaggagcggcatgtagcatcttttggtttgagagtaaaattccgcaatcagaaatgaaatccgagcaaagaagcaaagcgcacagaggctggagacgctaaagcatccaggcaggactccgccaggtgggcaggcagaggcctgtgcacaggcagacggtgtgcccgtgagcaggacatgcttgtagggtcacaggtcacccacccgcaggacacgcatgcaaggtcacgggtcagccaccagcaggacacgcatgcagggtcacgggtcagccacccacaggacacgcatgcagggtcacgggtcagccacccgcaggacacgcatgcagggtcacgggtcagccacccgcaggacacgcatgcagggtcacgggtcagccacccgcaggacacgcatgcagggtcaggggtcagccacccgcaggacacgcatgcagggtcacgggtcagccaccagcaggacacgcatgcagggtcacgggtcagccaccagcaggacacgcatgcagggtcacgggtcagccacccgcaggacacgcatgcagggtcacgggtcagccaccagcaggacatgcacacccatgtgtgcacatgggtaggtgtgctcgacccacacatgttgtgccatcaccccatccttgtccttggagaaagggctattggccatcgtgacggggagcctctcagctgcgactgggccctgggagccatggagtcttctggccgcctctcctggccaccaaccaggaaccccaggccccaggcccacggttgcatctgctgtgccatcctgtggacaaacggacgatccaatccagatggcactgcaggggactgaacggggctctgaaacccggccggagctgccctcaggccaccctcctcaccttgagccattcccctgctccgtcacctgtgtcaggcctgggtgccgccaggaggcctccttccagctctctgcaagctggccccgtgttcacgggcatccagcgggatccaccatggaaagacagctttctcagaggcatctcagcacgtgggcccagccagaacctcgagggcttctgtccctggagggcagggcagagcgggaggacacagggacacagagaaggtatcagctggcgagggcagggcagagcaggaggacacggggacacagagaagatggcagctggctgagggcagggcagagcaggaggacacagggacacagagaaggtggcagctgactcggcgggagcggaaggtgctgctttcttcgaggtccccctctttgcggctcacccttctccctctatggcccccttaaccccaacccccctcggctgcctctctgagtaaaggacaggccagcgccgagcaggtatgtcccctgccagggtcccccgcacacctggatcttctaggctggggagtagtggaaggatctgcggggctctcgaagccgtctgggaggaacgtcaatgaccagaggaaggaacaagggtttcgggtgggattggccaattccctgggtcatctcagaaccacgagcttgtcttcctgggttacagggtcctgagcttggccgaaaagggacaaacgaagggccgggtgtgatgaccctgcataggtttgacagccctgtgtccttccaaatcaagtgagtgggtctgggtccccggccccctccagcctggggtccaagcctccctggtctcctcgggcagtcagcctctctgctccagtgccgtcagttgtcacctacgtgggtaaaacgccaggagaggctggatccccagctcaccggcctgtggcccgggcatcctgggcttgcagagggagggccgagggtggtaactaggaggagtggctctgagccggggagggaacacggccagagggggatgaaggccacacggagcaccgcgggagccccgccgtctgcgcagggttcagcctttcagcctcgatgtgggaagtctctccatctgttcaggttttctttgggtctttttaccagccatgtttcgcagtttgcagcgtacaagtctcacacttcctttgcgaaattattcctaagtagcttattctttctgatgctatttgaccaggacgctttctgcatttcatcttggggtgttcactgtcagtgcagaaatatcctacgccccatgatcttgttaaactccttcgatcatcttatcaggttttacttcattttattttatctttgtagattccttaggcgattccacctacggcgtgaggcgtacttctacatcttttttgctaatctcggtgatttgagttccatgttcttgcctcactgccctggctggaacccgctgtgcagtgtgggaggagcgggaggggagggtccccttgacttgctcccttccgtggggagacggtcaggctttccccaggaagcgtgctgtaggtttccatagattcgagacggtcaggctttccccaggaagcgtgctgtaggtttccatagattccattgctaggttgaggaggttcactctcatttctggtttgttgaaagtttttttttaattataaatgggtgtcagattttgtcaaatggattttctatatcagttgggatgatcatgtggcttttgtcctttattttattaatatgatttattacattaattgagttctggctgttaaaccaatctttcagtcctgggaaatatcccacttgatcatggtgtacagtattatctttttaaaataaattgttggatttggccaggcacggtggctcatgcctgtaatcccagccctttgggaggccaaggtgggaggatggcttgagcccgggaggtcgaggctgcagtgagccgagatcgtgccattgcctgggtgacagagtgagaccctgtttcaaaataaataaataaatagtcgaatttggtttgctaagttaaaaaaattaagtaagtgtcccgctcagcagcattaattacattcacgatgttgtgtcaccatcaccaccagctacatccccaactccaaacagaaaccctgtctccatgaataacaactacccattcctctccacccccagcctctcttaacctagaatgtactttctgtctgtgaattaggctcttctagatatctgatgcaagtagaatcatacaacatttgtccttttgtttctggcttatgtcactcagcacaatgcttccgaggtcgctcagcagggggcttccgaggtcgctcagcacggggcttccggggtcgctcagcacggggcttccggggtcgctcagcacggggcttccggggtcgctcagcacggcacttccgaggtcgctcagcacggggcttccgaggtcactcagcatagtgcttccgaggtcgctcagcacagcgcttccaaagttatttacctggtagcgagtgtcagacttccttcatttttctggctgaatcctattcccatgggtggatggaccgcattttgtcctccattcatctgctgggggcaactgtgctgtttccacctttcagccattgtgagtaacgctggtatgggagcctaagtgtctgtttgggtgtttgtcttcattcttccggacctacccttgggagtggaattgctggatcgtaaggcagttcggtgttccactatttgaggagctgccaaatcgtctcccacggtggctgctccattttacattcccgccatcaattccaacttctccacatcctctctgaggcttgttattttatttttatttatttatttttttgagacagggtctcactctgttgcccaggctggagtgcagtggtccaatctcagctcactgcaacctccacctcccgggttcaagcgattctcctgccttagcctctcgagtagctgggattacaagcgcatgccaccacacccaactaattttttgttttttggagagcagccgtcctatcgcatgtgaggtggtgtctctgtggttttgattcacatttccctagtgaccagtgagtgctgttgagcatcttttcatgtgcttattggccattttatatcttatttggagaaacatctattcgagtcctttgcctatttttaaatggaatttttttgttgttgaagtgtagcagttctttataaatcctgggtattaaaacccttatcagatatatgatttgcaaatattttctcccactctgtggttgacgtttcactttcttttttttttttttttttcgtttttgagaaggagtctcgctctgtcacccaagctggagtgcagtggcgggatctcggctcaccgcaagctccgcctcccgggttcgcgccattcttctgcctcagcctcccgagtagctgggaccacaggcgcctgccaccacgcccggctaattttttgtatttttagtagagacggggtttcactgtgttagccaggatggtctcgatctcctgacctcgtgatccgcccgcctcggcctcccaaagtgctgggatgacaggcatgagccactgcgcccggctgacgtttcactttcttgatagtgtcttttaatgcagaacaactttaattttgatgaatccaatttatctgttttctgttaaaaaaatttttttttttttgagacagagtctcaatctgtcccccaggctggagtgcagtggtgcgatcctggctcactacaacctttgcctcctaggttcaagcgattctcctgcctcagcctctagagtagctgggattacaggtacccactatcatgcctggctaatttttttatttttagcggagacagggttttgccatgttggccaggctggtcttgaactcctgacctcaggtgatcctcctgcctcagcctcccaaagtgctgggattacaggcgtgagccaccatgcctggccctgtcttttttcttttgttgcctatgctttctgtgccatttaccattgccatgttgaaggtcgtgataatttgcccctatgttttcttctaagcgttttatagttttagctcttacatttaggtctttgatccatttcatgttaatttttgtatatgttgtaagataaatgtccaacttcattgttttgcatgtgtaaatacctttttcccagcatcgtttgttgaggaggctgccctttcctcactggtgttggtcccttattgaaagtcaatggaccatgtatatgggggttcatatgggggttctctgttctactccattggcctctacatccatccttttaccagcagcacattatcttgatgactgtagctttatgagtaagttttgaaatcagaaaacgtgagttctccaagtttgttcttcgttttcaagatcgtttgggctatttagggttccggaagttctatatgaattttaggataaaggttttcaatttttgcaaaaattgctgttgggattttgataaggatgacgttgaatctgtggattgttttgagtagtactctcatcttaacaacagtaagtcctccagtctgtgaacacgggtgactttccatttatttgtgtcttcttaatttctttcatcaacgtcttgtagttttcagcatacaagtctttttcctcctgggttgaatttattcctaagcatctgattcgtttcgatgctatcgtaagtggggttcttttcttttcggattgctcattgctagtgtccagctgacttctaagtaatgattttgtaccctgaatctttgctgagttcatttattaggtttaacagttttttttttttttaatggttctctgggcttttctacatggtgcatatcatctgcaaatacgtgccattttagttcttcctttccaacttggataccttttgttcctttttcttgcctaattgctctggctaaaactcccagtattgtgttgaatagaagtggcaaaagcaggcatccttgtctttttcctgatcttggggagaagctttcagtctcgtaccattgactgtaatgtcagttgtgggtttttcatagatgacttgatttactaaattttactaaggatattttggtttacgttcatgagggataatatcttatagtctgttcgtgtctttgcctggctttgataccagagtaattctggtttcatagaatgaattagaaagtgtttcctcatcctctaccttctgaggattttgtgtgagattgctgttatttcttctgtaaatatgtgatggagtttactagtgaagccagtgctatttgggcattaatttctttacttgttgtgggtgtcttcaggttttctctttcttcctgaactcattttggtaatttgtgtcattctaggaatttgtccatttcatctaagttgtcaaacggttggcataaaatggttcataatgctcctttataatccttttaatttcaataggatcagtagcagtgttctctcttttattcctgattttagtaatttgtgtcttctctctttttttcatgggcattcttgctaaacatttatccactttgttgatttttttcaaaaaatcaagtttgatgctgctggttttctgtatcggctttctgttttctgctgcactgctgttcactctggtcttttatattatcttccttctgcttggttggggttggatttgttcttctttttcttgtttcttttggtggaagattatattattgattatattattgatataatatgattatattattgacctttttgcctttgaaatatgggtatttaaagttatgaatttcctgctttagctagatctcatgcgttttggtatgttgtggttttgttttcataagttcaaattattttctaattttcttttttgtgatttcttttttgactcatgggttatttagaaatgtgttgtttagctctcaaatatcaacttatttctccagtttatttttatttttattttttgaaatggagtctggctctgttgcccaggctgaatgaaatgcagtggtgtgatctcagctcactgtaacctctgcctctcaggttcaagtgattctcctgccttagcctcctgtgcagctgggattacaggcacatgccataatgcccagctaatttttgtatttttagtagagatggggtttcaccatgttggccaggccggtctcgaactcctgacctcaggtgatccacccaccttggcctcccacagcactaggattacaggcacgggccaccgtgcctggctatttctgttcttggtttctaatttaattccattgtattagagaacataccttgtacgatttaaatacttttaaatgagtgagacttgctctgggtctagcctacgggctctcctgaaaagtgtggcactgctgctgagtgctgtcatcatggggagcgatctataaataagagtttgggtaagttggttgacagtgctgttaaagtcttctgtgtccttactggtactctgtgtagatgctttattcgttatggagaatgggcatcgcaatctctcatgataattattgaataatatatttctcttttcagttctgtctcattttacttcatatattttggagttctcttgttaggcatgtatatacatttatgtctttctgtcaatattgacccttttatccttataaaatgtcctctgtctctagtatttttttccttgaagtctattttgtcagatggaatatctgtgttccacctctgttgcagttgttatttgcatcatgtgtatttttctgtccttttgctttcagtgtatttgcatcttgaaatttaaagcatgtctcttatagatggcatgcagttgggcctggagtagtttatccagtccaataatttctgccacccgacagtgttgttgttggtttagtggcatttttgtctctgacgttttgttccttgctttctacatgtctcgtgtcttttttgtttctgttcctcctttactgccttcttttgtgttaagcaaatatatctcagttaccctgttagctaattctgctgccgattgtgttaattgttaaccatgttttgagttgtgttcttagtgattctccaggaaaccagtatatatcttaatgtattacaatctacatcaggtgaatactgacttaattccagtaaaatgtcacctctgatccaggacagagccgttcccgcctgaattgtgactgcacacccagtttgtccctgtgtccctctagcctgagggtggcgttggcttcctgtagttgagactttccgagttgctcctcatccccatggggaccttctcacacctcttcaaccggcatcccatatcgaacccctgggtatgtgctgttttctcccatggactccaatgggtgcaggcatctccacctgctgtggccctgaccctccccttcctctcgatgttcatggggcatttaggggcttcgtctggggatggattaaagggcctgggctcctggggaggagctcccctgttctcccgggctttcctcggtctcccactcccctcaccctttgtggattttcctgggggattttactttattaaacgttcatgagcagatattctgctgccaggaaagaaaagcaatgaccagagattcggctgtgaaaaaaagaaaatggaggggttgggacaccatatcattcataggaccccttcattccaaagctcagcattgggctgaggcctgggcggagggcaatggagaggtgcagcgtgggggctgagtgcggcttggctgggtccccaccggtggccacggcacctgcaaggccacagggaccccatgcggggaatccgtgggcctctgtcgtgaactgcagccagggaccctgaagggctcgggcagctggggtgctctctgcttctgctgcacgcctggctggtgcctgagcagctctgcgatgcgcatcatggtcggggctgttttggggccgtttccaacaccagcagcgtcgtggctccacagcagcaaggcttcctgaaggaagaagggggcttcgcagtatagttcgagtcgggctctgtttctttccatcccaaacacatagagacgaccaaggccctgatcccaaaagaagaacccaggctgccggcgatcctggggacaacgatgttaactcagggacaggcgcagtctctggaccaggccaggtcgtggtgcacacactcgatctctgcagcgtttcccacatgggcactgcggaccgggaatgtcaggggaacgcgggcaccgtggaccgggaatgccaggggatcgtgggcaccgccgaccgggaatgtcaggggaacacgggcactgccgaccgggaatgtcaggggaacgggggcactgcagaccgggaatgtcaggggaacgtgggcactgcggaccgggaatgtcaggggaacgtgggcacggctgaccgggaatgtcaggggaacgcgggcacggccgaccgggaatgtcaggggaacgtgggcactgtggaccgggaatgtcaggggaacgcgggcacggctgaccgggaatgccaggggaacgcgggcactgcggaccgggaatgccaggggaacacgggcactgccgaccgggaatgtcaggggaacgtgggcacggccgaccgggaatgccaggggaacacgggcactgtggaccgggaatgtcaggggatcatgggcactgtggactgggaatgccaggggaacacgggcacggcggaccgggaatgtcaggggaacgcaggcacggctgaccgggaatgtcaggggatcgcgggcactgccgaccgggaatgtcgggaacgcaggcactgcggaccgggaatgtcagcagaacgggggcactgcggaccgggaatgtcagggcaagagggaagttgtttgctagcttgtcatatgtttagctaattatttaatttccctaatttaaagtttcaccggattaacatcaaaacaaaaatcttgtgattgcagcatcataaagcaataatgtaattaacttgtttagggtaacttactaacttggctgattgcaaggcatggggtctgggggcaccacacttgaggtggtcggggcgcttgtcaggcccaggctcctggcctcagcgcggcgcccagctcccggtgcacagggctcccaggccccggtgaggatcaggccactgtgccgcctcagggagtgggtgccggcctcacccccagggctggggctctcactcaggctgcgggcaggcatctccttggcccagaagctctgaccttggccacagttgggttttgagcacgcagcccagcagaaatgccgttccgaagccgtgcaggctgtgcaggccgggacaccctgctaaccaggagtggaattgagaacaggatttctctacaccacgagttcctcccagaactctggaacagattccaatgttgtttgaaaagttaccaaaccctgtttgatcagcatccattgctgagagagcagctttctctcttccccttttcctcctcccctctcccacctcagcttccacagaggtggcgtgcatggcgggaaccgtctgtcctatcggagcctggagaccctgggtctttcccttcagcagcttccacagaggtggcctgcatggcgggaaccctctgtcctatcggagcctggagaccccaggtctttcccttcagcagcttccacagaggtggcgtgcatggcgggaaccctctgtcctatcggagcctggagaccccgggtccttcccttcagaaatccctgccatctggttttgagactggctttgggggacagtggccctggtggggattcgggcatgaaaggccccctgttgaggtcgagcctggcagcatggggggactcgctcgtcttcgtggtgggcctcacagacacagccatctgggcacacaagagcattctggccgtgcatgtgtgcaaatgagaaccgtgtgcttcagaaacagactggagcgtgtggggacagacgggaactcacacacacgtgagctgccccaggcccagcagacactgaacgtgaggtggcttgctacagccagtgggcagaaggggcaggttttggtgttgggaacccagtccccgaggctgagaaactgcccacaaacctcctgctgttctttgaagtgaggggttcattttgcgtggagcccggagcacagagcaggccccataccaccaggcaaagcccacctggctcacctgctccctagccccgagatggtttcaggatgaggcagtgtggtcaatttggagaaaaatcataaaaccaattcaagcctggctgcccaggttttgggatccaccaactgggctgctttttctcaattttagccacatcgccctcagttcgaggaagtacttcccatgagcttgtgctatggtgtgaatgtttgtgtccctccaaaattcacactgaaacgtcatccccagtgccatagtacggagccttcgggaggtcagtaggccgggaaggctctgccctcaccaatagattagtgccagtagatacaagggcgggagggatgagtccgttccttctctcccttctgccatgtgaggacacagcaccgctcccctccagaggacacggcagcaaggcaccatcgcagaagccaggagccgctgtccccagactcgaggctgcagtgccttggtcttgcacttcctggcttccagaactgcgtgaaatacatttcaatgctttataaatgacccaatcacaggtgttctgttacagcagcacaaacacactaagacagcttggtagaattttctagaagctatctgctgattaaacaacagggaaaaggtggagtctgagagggagtagtgtgtgaaggggccctgctgggagaggttttgggaatctgtgggcggctttatagttcttggcactttcattttcctcttgggggtcggtttggtctaggttcccccagtgccaactctgacctaatgggggttgggtttatctgacaggtgattgcaggaggagagggatggaggaaaacagtgcccaggctgggacaaagggggctcggctctaccggcatttatccaccatcccatctctcggtgcgttgacgccctggggagctcacccccaggcagaagagcacaggtgcctggtgtgttcgtgaagcatcctcagaacctgggggggtgtctagggtcctcagaacctggcatggaggggggtgtctagggtgggctgaagggcatgcacagcatctccctttaggaggaggaagcacctgccatccagcaacccgccgtgagcgccgtactgcacagtcctccctcacctctccgaggacagactctcctgcaactgaggagctggatgtctgccttttcttacattctacatctaccctccctttctgagtggtgtcagatcctcggcttgggaagaaaatgcaggctgtggtctctcagacagctcttcatggtgacacatttgctcggcacctgctgtgtccccagatcaatgccagtggcctggggtcagagggcaggtgcacgatttgggtccagtttttcccagtgggtcatatgtggatctggggcaagaaccaccacccaagaggacgctactggcatgcagccctgagcatttttctgtttttctttctcagctttacatgttcagggtgtagtcagatggctgtgtgcaactgcagttcactttcaaagctgtgtatctgttttgcgaatgtgccgccgtttctttacctgctcattggctggttttgtggatgtgctaccatctcattggtcagttttgtgaatgtgctgctgtctatttacctgctcattggtcggttttgtggatgtgctaccatctcattggtcagttttgtgaatgtgccactatctatttacctgctcattggtcggttttgtggatgtgccgccgtctcattggttggtggcatttgcgtggtcctcagctttgggttgttttagactcagcttcctgaacactcttgtccgggtctctcatcttctgaacactcttgtccaggtctcgcatctttcactttggctgttctgtgggtgtgtcgtgcgtctcattgtttgatgactgaatcgccattataatagcatgaaggtgcagctcacaagcgtccacacaggcgaattcacgtggtggctccagaggaatgttggccttgcagagtcttggcatctccgtggcttcccatgagcctgcgagaatgctgggcctgtgatggtgacagcgagtcttccctgtcctcaggggtgcggccttcaccttggaaacatcatttgtccccctctgtttgggttcaagtcaggttcagtgactcactagaaagacagacctgagaaacgcagttctagtcccgattatggtttattaaaacaaaaagacgcgttaaactcagtgaagaggagacgcttgtggagcagtcatgggcggcaggcatgagctgctgggagtgctctcccgtggagctgtatacacagcactgtttctcccagcagccagcccgggaggctcgcctgagctttggtggccatggtttttactggggctcagtcatgtagacttggagtccctgtgtggctgaccctagttactcagtctcaagctgaccctgtgtggccccaacctgaaatcccatcatttccttagactacccaacgtggcccaaagcccccaaaatacaatgttctaatggctcaggatggcttcccaggtgctcgttaattgctggacttttatttggaatgtgtggggtgtgggcagcccaggcctgctgagctcaccgtcactgcacgccctctgatgtggcctggctccaggctgttggcaatctgaccctcactcctggggtttccacaactgtgagttccctggcgggcccctgagggaagttctagagaagaaagaggaacacaggatcagcctcaggctctgggaggagaactggaccccattgtttgggcttggacagctgtccaattgctcaggacctgggtgctgggtggaggcctcatcagcaagtgtcctgactccacgggtggagggatctcacactgcccaccacagtggcagcctcagagtaagcacgagcctctcgccctccatgcgtgtataaacaacatggctggtgggtgcctaggcccccagggaggcccctggtatgaggccagcggagggggcgggtagggaggagccctctctcttgcacttaggtctctggagtgacagggatggccctgccccactgacccaggcgttcaccccagagaagcgtgcaggcaggtgagaagcttgtttggacctgaagaccagcctgagcgaggagagtcttgtgcagacggtttatccaggaggagcccggggagaggggggtgggaaaagccacagttttggaggtcagcaaggtcatgtgggggcagactcctcctcctcctcctcttcctcctcctcctcttcctcctcctcctcttcctcttcctcctcctcctcctcttcctcctcctcctcctcttcctccctcctcttcctcctcctcctcttcctcctcctcttcctcctcctcctcctcttcctcccctcctcctcctcttcctcctcctcctcttcctctcctcctcctcctcctcttcctcctcctcctcctcttcctcccctcctcctcctcttcctcctcgtcctcttcctccttctgccaggacccttcttccaggacccctgagaagcgcatagaatagcgtccaggactgtctgccccaggcacgctgaccactggctccactcccctgggcaagggtcgcccctgggctgctgcctcccagcgacacaggcaggacccagaagcctggtagaaagtgaccatgtgtggcaggtacaagaggccgagtgcggtcaacttgaagggacaggaagcctgcaggcagtgaccactctctaggctgtgctcagaggagaggccaaggggacacaggcaccagggccgtgggacacacctgggctaccccagctcctatcaggcaagcacctggagcctcactgtggaggggagactgtggccgccggggcgagggtgacacagggacacctgctggagaggggaacccagggctggctcatccactgcggccataaaacttcagcttttcctggatggtcactgtgcttggccagaggtcactggtgggaccagactctggccaggctttgagacatacgtgcctttccgtgtggtaggcctgaccttggaaggggaggccaagacctccaccccctcccctccgccctggcctgcgctgctgggaagtggatttggaggctctgttgctctctgcacagcccctcctggcctggcggcccttctggagcctgggagcagaggtgaggctggcatgggcacgaaatgtggaaatgctccacgcccccagggcttgcaggggaagcgaccgacgtaggtgtgtggccctcagggacagccccgggaagggaagtggccgatgtaggtgtgtggccctcagggacactcccaggaagggactgggctgcagaggacccgctcagggaagcccggcccagggcagggcaggtgctgaccctctgcatctctgcccatggtgtttcccccacctggagtgccctggccagtggctcaaatcctccatggcctcgagcctcccctttaggttccaatgccgtgctccacacagggtgctgtgtccagtgtcactgagtgaatgggagagtacatgagggataccatcgaggggagtctctgctgggccccacctgctccccaaccacacactcccccagacattcctctatcgagggcagtctcccccaggtcctacacagtcccccagccattcctctatggagggcagtctcccccaggccctatacagtcccccagccattcctctatcgagggcagtctcccccgggccccacacgcccccgcagccattcctctatcgagggcagtctcgcccgggccccacacgctcccctagacattcttctgggccccggggcatctgtgtggctgctgggacccccacaggggtggcgggtgtggctgcccctgagaatcatgctctgtagtgtcccgcccctggtgcagagaatcatgctctgtagtgtcctgcccctcgtgcagagtattatgctctgtagtgtccctcccctggtgcagaggatcatgctctgtagtgtcctgcccctggtgcagagaatcatgctctgtagtgttctccctggtgcagagaatcatgctctgtagtgtcctccccggtgcagagaatcatgctctgtagtgtcctcaccccggtgcagagaatcatgctctgtagtgtcctccccggtgcagagaatcatgctctgtagtgtcctccccccggtgcagagaatcatgctctgtagtgtcctgcccccagtgcagagaatcatgctctgtagtgtcctccccccggtgcagagaatcatgctctgtagtgtcctccctggtgcagagaatcatgctctgtagtgtcctccccccagtgcagagaatcatgctctgtagtgttctccccccagtgcagagaatcatgctctgtagtgttctctccccagtgcagagaatcatgctctgtagtgtcctccccccggtgcagagaatcatgctctgtagtgtcctccccctggtgcaggatccggaggggctgccaggccaggctctcagggaaggtctgcggatgcccaagtgcctgcacacctctgagggcccgtggcaagtgtagaaagcaagctctgggcagggctggctgctgccagcctcccacctccttggttcctcctttgtcctgcaggcttgtctcttccagtcttaacaatgctgctctcaaaagtctgaagccatagaatcccttcgaacagctgattcctctggagaatccaaaaacataactcaattcccaaaatttaactttttatacaacttgcaggacttgatgtggcgtatggagcactgaccgtccatgtggcaggactcagaggacgcgggcaacacagtgcccaggacagagaggccacagaggagcaaacgggcaggccgaggacagtcaagaccaaggggtgccaggcagggtgtgggcttcttgggcccacaatgacgggccctccatcgggatcctgtggggcaggccaggggcaggggcaggtggcctcataagcccttgaggaaggtgcagggggagttgctcccactccatggctgggggacaaggggaattgcatttccaagggggctgagccaagcatcctcaaaggcggcagttttggagcgagttggcaccataagcacagaagacagcaaacgttagaccctctcccaactgtggcggcctggagggagctcatgccacctcttctcgaagggagcgccctatgacctcctcaggtgaaaagacagagggcagtgctggcaagggcaccccagaccgcccccaccacaggtcggggagatgctgcaggtgcctacaggacactcagcttgcagtcatgggaggtcaccgccacccccctgcggggcctcctgagaactgaggccaacagagcgccctgcatgcccagaaatgcaacatgctctcccttccttcccctgcaggacccctcttcagtcactcactcccttccttcccctgcaggacccctcttcagtcactcattttggggcaattgaaggctttatttggaaaagacataccaaatttcctcagctgagcagatttttaagtagcaaattattatcaacccgaactgggaggccaagtcgtctgtagaccctgtgaggagctgggaggtcacttccctttcctctgggtggaaggggacgcctgagagccaggggcagaggaagaggcagaaaggagggaggggacagggagagaaactgcaggtggacagacaggcagggcctggagtcctggagctcagaggggacaggagcccacccacagggacagcccaactctgtcttgtctttttgcaaaatgctcaagctcaaagcccggctgaggctgctttaaattagatgctgcctcagcgggtccctctggagttgttggaaatctaattagccaggcagcctggcacaaatgtcctaattccctgacgctgggggacgcgagtgtctctttgctgctggggttcccggcctcagcctggcctttgcactctgcttgttttccaggatgatgcctatcagaaaccctaattgttttttcagaaacggctaattaattaggctcagcctcttgaaaggcacttaaaatactaacgacttgctaaaaaagggcaggacttgaaagcaaagccaaggtccaaagtgcccaccagcgtgaggggtctgctgcctccctgcggggaagccctggcagagccccttgctttgctgctcacagagtccaggacatgagagccgagcccatgcaccagtgactcacgccccggcacagatgagcccagagcccggaacagaggccgtagcaagaccccgggagcccagcctcccctacccctccagccccgctctgggccccaggaggctgacctccatggatgtcccagcaatctgtctctggcctctgggtgggtgtggccaatggagtcatccgggacacggaggtgggaagggactgggccctccttatcaggtctgagggtcaggggccctacatctgcttgtccctgttctcagcgccaggctcacctcatcccctgccccttgtcagagctccttctttgaccctccccaggggtccagctcacttgtttgttagtgacctcatcacagacaagttctcagccctcccatggggcggtcggtccttcaggcactggaaatacagcggtggacacagtggtggacctcccggtatgtcctctgttcgactgaacagtcgggttgcggggcctccaggagctctgtgagcccgtgctcaggtgcacacaacagaagtactccgctgacgcccacccctttcactcagctctcggttcagtcatcgccaagcaactgagagcctttgtgaagaggcttcctgccctcttcatcttccacagacacgctcttcttccttaagcccaggcatacacagacacagtgaatgcacacacaaagacacacaccagtgtgcacactgctctggaatccacaggttctataaatatctagaaatgatatctgaaagtgcattgttatatgcgctggtctgtgatggttacggtgatggtgattcctccttccggaggatggcgcggctgcagccagagggagattaggtggcggaggcttcgatgaccatttacattttacgagtacttattttgagtgtgtatttggaaaaattaaatttgtatatcaagcccatgatttcacagatatttttgcttaggtcaaaggctaaaacaggtatttaaatcaattcgtttatttaacttaaagaaaaatatgacgggttaaggttgggcttccccagaagtagatcccgaagcaggaatgggaggtgtcccagcgtggcggcgagttacttcaaactgggtggctttaagtaacgaggattcattccatctccgttctggagctggacatctgaaagcaagctctgggcagggctggctcctgtggaggctctgggagggggtgtggtttcttcctggtcccttccagcttctggtggctccaggccttccttggtgtccccggcttgcagccgcatcactccaatctctgcctctgttttccgtggcgtttttctccaaatctacctgtctcagcttctccatctcttatgagggcacccttcatgggatttgaggcccactctaatccatgatccttaccctaattacatctgcaaagaccttattccaaataaggccacattctgtggttatgggtggacatatttgggggccctgttcatcctacttaaggagggaaagttgtttattttggaggtgactctgagagcacagcagcaggtgagtgggaggtgagatgcccagtgaccagggcggccatcaggcaggccacggccaggcttctgggctcagcctcaccaggtcctcagctgcccagggctttctcacccaggacctgcctggagactgctccggggccatcaagtccccggcatgtcagcccaccctggccagaaacagcctggtcaaggggcacagggctgtggagttggggtgcccaggaaggggagaaccagcggggtccatgggccaggagagtccagccttgaagatgggggtgtgaaccacacagtcacggtctcaaaggcacagagctttgaaagcaaggtagtagctcctcaagccctctgggcacgccccaccagggtttgtgtgtggagttaatagggggcagttccaggagcacaccagaggggccggggcagccggaggggccagggcagtggagggctgggcagctggggcccaaccccagtggggactgagaggcctcgtgactgctgcctcagatccacctctgaagggcgggaagcctgggctctccctgtcccccacaaaccagggctggggtgtagctggggggtgtggagtgaggctggtgagaggtgcccgacgggagaagggccccggtccagcagctttccctgatcaaccaagggggatctattttgtttgtaaaaagctgattatcatagataaatgtgtctaattagtctcatttgctgacacacaagcctttaattgcaagttgaataattagacatatctgcatatgtaaatgatacagttataccctatgtcagtctttaacgtgattcctccagagacaaataattctatttcaggagagaatatgatatattaatttacatagacaaacaactttatttagaaccagcaactctcgtgtttgtttacataaagtaataactcgagaaatgggaaagatcgatgttgcagcaacatctggaggctcctaacctgcaggggagtccctggcagcctcccacgggagctgggtcttcctccgccctcctggggccccagtcctcccacgtggacagcagctctgggcctgggggtgggctggggcccaggccatggggtctccctcccctcttccccctccaccctccctcatgccatgcttcctcctctgccccttgtcctcgctgggtggcaggatgggtgagatgcccggtggccctgcaggcctgcagctggcccagtgcatgtgggtgtcccctctccatggctgtgccctgcatgctggcagagctgccaggggcagcttggagcaggagcagctggagcttgggtcctgattcaggcagtgctacagccggctccctgccaggccctgggtcagctgcccacctccccagtgggtgtcatgctcagcagcctcaggacagggctggggggctggctggtgccgcctgcctctgtcaggcccccggcctccactctggctgagtacatcgtctcctctctgagctgggcagggcagccactggcgacccctggcatcctccgggtctgactggcggggacagggctgcgaaagcatttggaggcctgacctggaaggaggaatgaggggccagctgagggcgtcccaggcagagccaggcttgcgatgcccagggtgcccggggcacagagtggcccggccgctcccacaccccttcccccttccctgggcccgtggtcacatgggtttcgctgggaggcagagcgtgaggaatttggctctggtggaatgaggacggctgcactccctgctttgcagagggcccgcacagcagcccgtcactgtggcaaccggctccgtgatgctggcaggagctgacatcgtcccaattcgcccctgtggtcccttttggtccccctcccctcgaccgccaggagccgctgtggatcgagttggccagcagagggcagcagagggctggcggggctggcggggctggcggggctggcggggctggcagtggacgccacactttggggtctccaggcccccaagtcttctggggaaagcagcagacaggcgacagccacagggatggggaggcgccatcactactgcaaccactgggggtagcccttggcccgtctgggggcatttcatctttggcagagctgaggggtccagcacgtgggcctctaaggaggggtctcccgcccaccgcccccagtgctactgtgaccgcggcggctcggccccgcctgcactcccaggttctcactcatgcagtcactcactcattcgctcgctcattcactcgctcattcactcattcattcactcgctcattcactcattcactcattcacacacactcatttgttcactcattccttcactcaatcatttacacactcatttgttcactcattcattcacatacttatttgttcacttattcattccttcattcactcattcattcacacatactcatttgttcactcatttccttattcactcattcacacatgcactcatttgttcactccttttttcattcattcattcacacacactcatttgttcactcattcattcacttattcacatacactcacgcatttgttcagtcactcattccttcattcactcactcattcacacacactcatttgttcactcacccattcacacacactcatttgtacactcacacacaatcatttgtttactcactcattcacattcactcattcatgcacacacttactgattcatgcacacacttatttgttcactcactcttgttcactcattcatttctttcactcattcactcacacacattcactcattcatggacacactgattcatacacacagttgttcactcactcattgcttcattcactcgttcactcacattcattcacacattcatttgatcagtcattcattcatgcaatcatttgttcactcattccttcactcattcattcacacactcatttgttcactcctttcttcactcattcattcacacactcatttgttcactcattccttcactcaatcattcacacactcatttgttcactcactcattccttcattcactcattcacacactcatttgttcactcgctaattcaatcattcattcacacacactcatttgtttactcactcatttgttcacccactcattcctttagtcactcattcattcacacactcacttgtttgctcactcattccttcacacacatgcactcacttgttcactcactcatccacacacattcattaatttatttacacacactcactcactcatttgtttactcagtcactcctttgtacacagggaaagagtaaggtacctttccctcctgttcagctgctgccagaagcagtgtccagttctcctggtctaagcaggactcaaggtcctgcagcagctcagcagcccctggagctgcagcgtctcctttgttctctctgaagggggcatgccttggccccaacattcttgtccttcattttttgaagtttcttccccctctctcctggctaatctcatatcttaactaccaatataagacaaaatatttctgtgactttctttccaattcaataaatccatctggtgagaagagaaaaaaatgcaagaagagaagaggcaatgccgcaccccaaaccctgtcagtcactcacactgaggacattttcacgaggcgttaatgggtgatgtttgaattctggttgccagcacagatcagggcaaagctcttgtaaaactctattaaagtctgtggatccagctgagacacagggctgggaaacaaagttaactgttctccctcctgagcggcttgtggttcaggaaacacccccaagcccctgccttgggggatctgtgggtgagagggaagcatatttggatacagcttcaagagagaggtccgactgctctgtgtgtacacgtgtgtgtggattgccctgtgtgcaccagctctgtgagtgcctgcatgggagtgtgtacacacctgtgctctgtgtgcatcctcaaacacaccacaccaacaggggtctggcattgcctccctacggtgctcatggtgaagtcctcggactccaagcccctcttctgcgccagcagtgaccaggctgtggtcagcatggcctgttggtggcctttgacttcctctgttggcagatggcttgaggccccccagttcagggccacaggtgacttccccctttcccaggtggtggggccctgtaggcttgaccagccccaggctccagagcgcacagaggtggctgtccacagagcgcgggaggcatgggagggtgtgctgctgcctgctggtcatccagctcctcgcccattaaggagcccgctttcccctttgggaggccacaggggctggcgaaggcccttcagctgtggctcaggtgggctgggcaccactgcaggagaagcctcctccagatgggaggaggtaggaggtgcctcctccagatgggaggaggtaggaggtgcctcctccaggatcaaccccagctccttagcaccagcgaacagacacagtagacacacgcaggaacaagcacatgtcccaggctgcaccgtctgtgtctttccctttttggggtccttgcatttcacccttacctggttctggattcagcttttaagggcacactgattggcagccaggccactgtgagcgctggctccaaatgtccttttgttttgttttgttttgttttgttttttgagatggaatctctgtctgtcatccagcctggagtgcagtggtatgatcttcgctcacctcaacctccgtctcccggtttgagtaattctcgtgccttagcctccccagtagctgggattacaggtgtgcaccaccatgcccagctagtttttttgtatttctagtagagacgggttttcaccatgttggccaggctgctctggaactcttggcctcaagtgatctgcccacctcaatctcccacagtgctgggattataggtgtgagccactgcgcccggcttccaaatgtccttgacaacggccacagcatagcctgcagccaaggggcgagggctgatcgcgagggcctgtggtcattcctccaccttcggtgccctgcctgggcacccccgtgcagctaccacgtggggaaggcacttggcctcttccctcatctgcagactcagccaacttctggggctccctcggcagttggggctaactcagtgggtcaggtggaccccggctgtgcgtgcagcccccgagagggtcagcaggggcgcggaggcccccttggctctgctttgttctgcctgcggctccggttggtttgtgatatctttgattccatctcttgcccccatgtgaccccatcgtctgcctggccgggggctcccttgttggagtgtggggcgagcccccacccgtgtgggaagaggagaaggccaggctctaagccccactcagctcctcgtcctcggaggggtcctggccctaagagggcttgttggggtcacgcaagctcacaatggctgtggtcctcagcaggtgggacaatcgggctgttttccgatggtgtttggcagaaagtgggagtcaaagcttagaaaagccctgacagaaatggttccctgaggctggcgggagagtggcactcgggatattaaaacagcgaagtcggtcctggccaattatcagccagctggccttgctccggcgcccagagctcacagggtgagtcaccatctgcggctgagcatccctgttcagtgagggagacagatcctgtcctggtccctcctcccagctgtttgtggcctccctcctcaggctgcctgggaagctgtttcagaaccttccagtcccctcctggctggccctggggctctgtggaagtcctgcttcccccagcagtgcctggccctttgtccccgacccaggaaaaggtgaagtgggggtacttcctgtgcatgacacgcccccttcccttctcccagcctcctgcctcggggctctggcaagaaagagggcctgagctgcaggagaagggcttccttgagcaggaagaagccctggcccagggcagggtgcccggaaggcggaaggatcccagcccaagccacagccccaccagatgggtgggggccttcatcacaagaaagatcagagagttgccctctgaagccttcgcagtggccctgacacaggctgccagggatccgtcactcaagggaaggccctgggggtggggggctctggcaggggtgaccacagtggttaggggcctgggtgagaaaagggacccctgatgtcccatcagggccgggaggggaactggaggacctcctggcactccctggcccctcctctggtgcctagcaccttccagtgcttttcccaagaggaagggagagcctggtttcattactaagccctccatgtcctgtccgtgtccgtgtcctgtttgtgtctgcgtcctgtctgtgtccatgtcctgtctgtgtccgtgtcctgtccgtgtcctgtctgtgtcctgtccgtgtcctgtccatgtccacgtcctgtctgtgtcctctccgtgtccgtgtcctgtccgtgtctgtgtccatgtcctattcatgtccgtgtcctgtccgtgtcctgcctgtgtccgtgtctgtgtcctgtccgtgtcctgtctgtgtccgtgtcctgtccatatctgtgtccgtgtcctgtccatatctgtgtccgtgtccgagtccgtgtctgtgtctgtgtccatgtccatgtcctgtgtccgcgtctgtgtctgtgtccatgtccatgtcctgtctgtgtccatgtctatgtcctgtccgtgtcctgtcagtgtcctgtctatgtcttgtccataacctgtctgtgtccgtgtcctgtccatgtctgtgtcctgtctgtgtcctgtctgtgtccgtgtcctgtccatgtccatgtcctgtccgtgtctatgtcttgtctgtgtccatgtcctgtccatgtctgtgtccgagtcctgtccatgtccatgtccatgtcctgtccgtgtctgtgtccatgtccgtgtcctgtccgtgtctgtgtctgtgtcttgtccatgtccgtgtcctgtccatgtcctgtctgtgtccgtgtcctgtccatgtccgtgtcctgtccgtgtccgtgtccatgtccatgtcctgtccatgtccgtgtcctgtccgtgtctgtgtccatgtccgtgtcctgtccatgtccgtgtcctgtttgtgtcctgtctgtgtccgtgtcctgtttgtgtcctgtctgtgttcgtgtcctgtccatgtccatgtcctgtccgtgtctgtgtccatgtccttgtcctgtccatgtctgtgtcctgtccatgtctgtgtcctgtctgtgttcgtgtcctgtccatgtccgtgtcctgtgttcgtgtcctgtccatgtccgtgtcctgtctgtgttcgtgtcctgtccatgtccgtgtcctgtctgtgtccatgtcctgtctatgtccgtgtcctgtccgtgttcttcttcaccctgatgtgggggagctctttcggcctttcctttactgcagcccgaaaaggaaaaaagagggaaaagcaggcacatttcttgaccagaaaaaataaacaaaaacaaaagccccttgtgctccatgggggagagcgtgaagcccccgagcgccactgcccccggtcccaggaggctcaaagtcctctctgctcagagagccgggggtgcttggccccaccctgtcccccttcccagccacttggtatttacatgtacagctggaccccgagagaatccccattctaagcccaacagtacattctggggcgttttaaagaagataagaaagtagctcagaggtttgccaggctgcctcattcctgggatttttagtgtgagccttggagctggtgggcttgaatgtggggttcctgcagttgggtccccctgacgcccccggcccttccctgtcactccggggtgtaattaggagtgtcccccaggattgagggagtgtggtctcgagctggttggactcaaggctgttctacttttttctccaagttttgtttattgtggtaaaacacacataaaattttatcatctcagccatttttaatgaacagttcaatgacactaaggacattcccatggttgtgccatcaccactgtccatctccagaacgcctttcaccttcccaaacccaggctctgtccccattaaacagctccccacgcctcctcccccagcccccggcctcccctttctactttctgtctctacaaatgtggcagctctgggaccgcgtgtgagtggacacctacagtattgtcctctgcgactggctgatttcattagcatgtcctcaagcttcatccacgttgtagcctccgtcacaatttccctcctttttaaaggctgaataatattccattgtgtggatagacacattctgtctattcattcatctctcaatggatacggttgcttccatgttttagctattatgaacaatgctgctgcaaacatgggtataaagtgtctctttgagatcctgctttcagttcttttgcgggtgcactcagccgtggaatggccggatcacatggtcattctgagttttgttttgttttgttttgtttttttgtttttgttttttttgagacagagtcttgctctgtcacccaggctggagtgcagtggcgcgatctcggctcactgcaacctccgtctgttgggttcaagtgattcttctctgtcagcctccccaatagctgggattacaggtgccggccaccacacctggctaatttttgtatttttagtagagacggggtttcaccatgttggctgggctggtctcgtactcttgaccttgggatccgcctgccttggcctcccaaagtgctgggattacaggcatgagccactgtgtccggcccattctgagttttttgagggagtgccatcctgttttccacagtggaggcaccattttacatcccccaccagccgtgcacgagggttccagtttctccacatcctcaccaacatttcttattttcagcttcttcttacggtagccatcccagcgggtgtgaggcgcatcgcactgtggttctgatttgcgttttcctcatggttagcgatgttgtttcacgtgcctattggccgtgtgtgtgtctttttggagaaacacttagccatgccctccatgcatttttgagttgggatttttgctcttattgagttttaggagttctctgtacattttggatgttcattccttatcagatatatgatttgcgaatattttctcctgttttctgggttgcctttgattctgctgagattgtctgttaaggtgaataatttaaagttttcctgaagtccagtgtgtctgttttttcttttattgcctgtgcctctggtgtcatatccagggaaccgttgtccaatccagggtcatgaagctttgtgaggctgttctactttatttccagggagctgcacaacctggggtcttctctggggccgtgggctctgagggccgaaggccacgttccccgggtgttggtgtggacctcggcacggcccccactgacctgcatgggccgaggtcctgcaagagaacgggctccatttgcgtctgagggccaggatgcctgcactggggatcacgctgtgcttcggatggagcctccaatctcggggatgccattttaccctggaggccatcgggcttcatgccccacgggcattgtatcggcttccgtgtggccccgagagcagggcaatccgagggcaaggccaagggagtggtgagcgtggcctgcagggcggagccaggcgaagtggggtggggctggaggccgcccgggctctggttggtgggcagaggcaggaagccactggtagctcagcacagcacagggctgatgtcaggggcggcacccagccaagacccagggagctgggtgctttcagcttctctttgccagtcagctgctatgagggcctaagcagtccccatggcttcctgctgagacacctaggtcccccatgacttcctgctgggacagagaccccctctgagaggcagatgccaaccctgagcaggcccccgaggttccctcccattctcctggtaccagggctgggagggcagggttccggcctgtggcactcaggctggtgatgtcagaatacgctgcgggtgccctggactcctgctccggttccctgaggggtcatgaccttgagtactcatgagagacagcttctcacactcacttccgcgtgccttccccaaacgcggagctgcctcctggtgcagcctgaggcattttctcatggtctgtccagaacagtttctgggtcagattcagttttcagaagcagaagccacagcattcgtcctctgctccgtccacacgcggcacccaccccaaggaggcggcacagcctggcgccagccacagggctcagcagagagaggggaattaaacagccactggctgggaaaggacgtttcaagggcgtaccacgcggccaattcaatggaaaaccaaactgcaagcgggaatgtgcatcagaaccagcccggagccagcaggcgttgctggagcagggtggtgggaggtggcgttccaggcctggttgcactccggtttgtccttcaggtgcgtgaggccgcctctgccatggctctaggcacgtccctgccagtgggggctccagcataatccctcgtcctgcagacacagcaccccccaccccccgcaggaagtgctgcatccggctgcctgggccgtggtgcccctggggtcagggacgtggcaggtgcggaggccgtgctcggtgccaggctctgagaggtgacattgcctcacctgggtcgagctccagccaccgaggacgatggaatgactggggtgtcttccgggagccgtttgattgtctctggagaatcagccgaggctggtgccgccttggagcaaaaacaggggaaatgagactccacaccttctgccaagactttaattctcttccaagcttcagaactgaaataattttagaagtcattgttcatcagctggctctgttttccacagcttaaaaatgtcctgaatggttgtggagtcagggtgctaaaataacaacgcaaaccgggaggaggccgggatgcagacagaaagagaggacccggcctgaaccaagcactggccacggaggctcgtggcagcgctgaggggaggacggtagcctcctgcctgtggctgccggggctcacatctgagcgccactggcttaccaggactccgactgggcttgccaggcagcggcccttgggaaccggggacgtccaggcagccaaggccttgctctcagccatgcatgccactggccttcaacaggctttccttaggtcggcattttaaacaaaccccagggtgggtcctggtgaggatgctctgttctctgtgctgtcctctaactgcagggacgctgggtccgcagcttccatgggctgggcggctctggtttgggccggggtggatcctggctgtgcattcgtggacatcagcttctctagggtttgggatgggggatggtttatctcaaacccccaacccctcactggacctcaggcctgctgcaaagcagaggctagggttggctttaactcgctgccccatgcaggctgcggacactccaggagatgctctgttttcccgcccagcagtcaccatcacggagatggaggcctgaggtgcggtcttttccccctgcttctcttcctcttgtgggaatcactgcaaatgagaccacagcagcctgggccttgccagcagcaaatgctcagtggtagagccaggcggccctcttctcctgaaagccttgtcctgggtcaggcccgggaagaaaggatggggacaggaaaggacgaggctgcggctgccgtcccccagggcagccacgcctgggcagcccccggacagagcctgtttcagccctcagacttcacggggcaagatcacagccctctcacctggcttcatatggcagtgccacagaggcccctccctgactgctccaggctctccctgacccctccctgacctctctagggatctcgtggggacccacaggccatacgacattctgagggcctggaacggtgacttccctgacacttttctgttattttaagtaaaataatacatgctcaccaccaaggccatttctggttgaatttttttggctcagattagataatgctaaattttatgctaatttaaagtgtcaaacaagaggccaagccgcggttctccgtggtcccctgctgcaccaggttatgtaaccgtgtttctcctgctcgtttgcctggcgccgcccaggcccgtgtcttttctattttgggtgtagacggaggtccttctgtctgagctttggagcacaagggtctgggcgtccttcagttaggggaagggctttgatccctgagtgcctgcgaccttgtggggacagcgtgatcatgaaatatggaattcaaaggttcccaggtttgagatgttgacacgtgagtactttgccttcaccagtcctggaaagacctggtgggggaagaggacaatgacaaagttgctgtgtggatgggcggcgcgtgcagaaggcagggcctcgggctgcagggggatgtgcccctgtctgcctcctgcctcgagtggtcaggccggtgctgggacatacccacttgccccaccccaacccggaaggacagtccttgtgccgggcccttcccacgggagcatctgtgggatgcagagcctgccagcaccggcatgtccacctggggccactcagcgttttgtttttgatgtcaaggtgaatgcccctgtgtaggttcagcaaaatgaaggactgtatattaagtgtgttacacacacatgaatgaatgcctggacttgtagaatgaggaaactcaccaagcacctacaaggacctggagaaagagagaaagaggtgggagggaggaggggtgggccgagacctcagcccgtggagctcatggtgggtgaggggaggagagatgcttaggagaacaaaagccagcctggctggtggtgaggtcacggccaggggagcacccagtagaaggggacagcagctataaacactgaggaccaggaagggctccctgcaaaggggcagtgtggccaggactggagggaggcaggggcgtcgagacccgcgggggcgtcgagacccccgtgtgcctgagcacggcctatgcctgccctgtggctacgatgagaaacatcccacgtgggctgccagtggacgaattgccagcacctgccatctcctgacatcactctccttcgaggctcactcttcttcactcagagttgctcacggattcgcctgttccctcattcactcattggttcagccaccaaattactcattcattcattcattcactcacttattcatgcgttgaacacctggctgacgttttggggagcagggttgggatgtgcagcaccccacagcgctttgtggagctctgatggcctcacactccttgaccaccaagcaccagcccctgggccgcgagccagccaggctgttgccgtgtgtgagacccagaggcagaggtgggagctgggccccacgctgaattcatgggcttttgtctgcctctgcccacctgtgtctgtttattcacccgtcccctccctgcaccccagtccccacccccacagcagcaaaggcagccccagtattgacacccagcagtggggcctgcaccccagtccgcacccccacagcagcaaaggcagccccagcattgacacccagcagtggggcctgcaccccagtccccacccccacagcagcaaaggcagccccggcattgacacccagcagtggggcctgcaccccagtccccacccccacagcagcaaaggcagccccggcattgacacccagcagtggggcctgcaccccagtccccacccccacagcagcaaagtcagccccagcattgacacccagcagtgggggccgaacagaccccagacaaggaggggccaccaggaagcctctgccaacaacagccccactaggcctcccgcttcctgtctgccctgccagccctggtcaggatagcattgagggtgagggcatcgggggccatggccaggatgggaggaggcagcgctgccacccaccacccccggctctggggagctggactcggtgcccatcccactgaaaccatctgctgtcctggagcccagagatgcccgggcctgccgaggtgggcagcaagaaggtgcgatgaggtgtttctacagaaatagcaggctggccatcccacagacagcacaaggaccttccccctttcctcccagagaggaatctgcatgtctcctccctcccagagaaaacaggagctccttgtccaagtcattcagggattttccaagggagagggagtttttttattgtttgtttgtttgttttcagagtcttgctgtgtcactgaggctggagtggagtgcaacggcatgatcttggctcactgcaacctctgcctccctggttcaagtgatttttctgctcagcctcctgagtagctgggattacaggtgcacaccaccacgcccagctaatttttgtatttttagtagagatagggttttgccatattggccaatctggtctcgaactcctgacctcaggtgatcagcttgccttggcctcccaaagtgctgggattacaggcgtgagccaccgtgcctggccgggagggagtttttaaagaggtcagacctcttcctgattttggggtgcagagccagcaccatccaaggagatgctgcggggttgggagggaggaccgggtccatgctccccagtggaggtgccggctctgggagacacagggcccctcgccctgcatgcatgcacatgcggcttctcagggcagctggacttgctctgttcatgagctcttggccttctgaaactgctagttagaggccagttagaatgcttggcctagagaggcccctgttcccccatcggagctgagctgccatctctcatcagaggctcgtgtcagaaagccctggtggaggaaagccaacacttgggaagcacagggaggcaggctggacccggcgtccttgcgggctgttggcaacaccgtctggagagggaccgggccctgtgcccgccagtccccagggcggggcggcctgagctggcctggtctgctgtccttgggatcaggccaggactcagctctgtgcctgggggccctctccaaggtgctgacgacaccatgttccagccttcactcctgccagcctgggagaccttcgagcggctttaacaaaccccatcgcaactgggcttgccttgaacacagccctggacaatggctctgtctgggtgtctttgggaatacacgtctttttactaacttcagtcagaccttcagccttccttgatccagcctctctgttcttcccctgctcctcctccccaccccaccctccctcccacagcaattccccaaaggagcagaggcagagggagagccttcctctgcttgtcccttgagaagaggatgtggaaacgtcagagattctcctgagagttgcaggcaggcagggaggacagacgtacttgggacacttcctgctgtgattccaaactctgctgacccaaggaggaggtctgcatgccctgcgctgttgactgtgtgacactgtgtttatgctgaaatatggagtcccaggaggctgggccatttccctctgtttcttttcttttctttttctttctttctttctttttttttttttttaacacagggtctcactatattgcccaggctggtcttgaactcccgggctcaagtgatcctcctgcctcggcctcccacagtgttggattacacgtgtcagccaatacgcctggcccctatttcctttcccacttaatgaaacaaaatatttagctggataacaattatttcactttctgaagtcaacacgagtctatttgcaaatacctagaattcattctagtagcaggaggcaaaactacgagcctgtgttggtcagcgtggctctgctgctcggcttttcatgccacattagatgggcatctgcccagtactgtgtccccctttgcccagcattcagcccttgtcattgagaggggacagatgcaggtggaggatgagagcaggctgccagagctgagtgtgggcaggggtggaggcaacctgaagtagacactctgctgggtgctcaagctgccaaaccctgctggtaaaacagagatgcctaaaggatttggagccagacagggaggctgagtggggggaaacagcccagcatggtgggctaggtcatgggccctggacaactcgtgtctggtggagtgctgactctgcagtgagggtgtgaccttggggagctgagaagattgaagagctcatttttgaaccctcattcctttcttggtttcctcatctgtaaaggggtcatgttactagggtctcatgtaaactctggccccttggtcagcactcagcttcacaggtgttgcctcggtccccagctctcaggtgcccgggctggtgagagggcactgcgccaggcgcagcagctctgcaaaggtggtgacccaggacacctacccttctctgcagctcagcccgtgaatttgcaccacaaatttcaatgaagtcatcttaagaagatctcactttgttccttcttccagaggcgggtgggtgggaggcccagctcccctttcagagaggaccttcctcacatgctaccctgtccagccccacgccgttttcggtgacaggggcctggacagatccctggttcagagcccaccccactggaagtacaggagactgagtcagaggccagtcaggccggatgagatcaacagtgatttgcctccaagccctgattcctccctgaggaatgctcctgagaaaacgctggctcccactcacagctggagcttcaaaggttggtctagcactgaccgtgtggacccacgtgcttctgtctggaaaagccccacaagccccgccccataagaccccgcccctcttagctccgcccacaaggccacttcccagctccgcccatctcgcgtctgtaccctacaggctctgcctggttccaccccaccgcttctgccacccactctaaggacccgctcctccccgcccccgcccccaaagccgctcctctcacggcccccgaccccgcaggcaccgactgttctcagccccgcccctcgaggccccgccccgcggcttcccgccggggattgcggctgcgcctctgaccctccgctccgggctccgggctcaggtcccacacctgcccgcgcccccaggccccgccgtcccccagagcctgcagcgggcgccgcgcaggccgccgggctcctccgggtgggccgggctcgggcttttggagccgcgcgcccaccgacccctcccacgggcggcggggggagagcccacccagaggcgcagcggggccggtggtgtttcccgccctcccagggggccgcgggtccgggggcagcagcggggcgcggggcggagggaggcccggcgggaacgggcgccccctttgcacccacagccgtggaacgccgaggtctcagctcccctacggcgcgcgccccgagaccccgcaagggcagtgctggggacgcggggccgagactcgaggacgcccgaggccgggacggggtgtgggggcgtcccccaggctcccgggtcccagtgcaggggctcgcggtcaggaggttaggtggatgagtgaaggggaaaagcgcggttctagctgcctgctcaggcttggggcgatgtgaacgtcggggtttgcccctcgaccccccaccagaacgcagatacttctcagcaaagaggagcttggggcagcccactccccacagaggaagggaggggcccgctccacggaggacctggggggctggaggaacaggcacccccatgccaggcaggacccgagggatcggtacagggcacggggagaggggcctgggggaagctgttgaccccgtgatcctttttacaaacttgtaaatcagagagaaattaattcagatgctgcaattttttctgataaacctcgaaacatgtaaatatcaaaccctcttccttcagtcactaaaacaaatggaaaacacatttattagcatagagatgagtttaatcaaatcagcctgagtgcaaattagccacaggaaatgcaatgagctgggaattaattagcagcgtaatgatgataaggtggcctgctgactgcctggaggccgcctctccccacggttgccgggctcctggcagctcagcttttcctttgcaagaggccctgagcggggaccactggacagccccctggaccccttggagagctgcagaggagaggcttcagggggatgcctcccttggggggcaggtctgtgtgttctaggggagcccagcctaccctcccccggggtgctcgtggcttcctctctaggaggccagggatggggaatgaggccttgggatggtttgaggccttcgggagcccaggagagggcctggccccagggcagtccggcccagagggggctgcctgctctgaaggaggggcttcccaatgtagaggtcccagtggccctgggtcccagctgggggtggactttggtgacaggcagcccccacctgaactggaggagcctcatcgagggtcctaaatgatactacagatgagacgtgcatttcaaatctgagggcaaggctgggaccctgggccctggcacgtgggactctggaatccacctgagtgcccattcctgcaggaattcctgagattgcttggcaccttgcgggttgtggctggtactgaggtgagcggttgaaatgtcccccaggactggtcagctgccctcccagttgggctgggtgcccaagtgttcacagggctcttgggaggacctgggtggccttgtgcaccctgggggctgttggtctaagggtgcaggggctccctggaggtcgggagctctccctggggccagctgcagccctgcgatgtgccctcccctccctgcacaggctggacacacagggacacttcttccccggaggcttctccagtccccaggaatctgtcccccacctgtcatcaggaaacttcagaagatcaggaatttttttctggagctgcattttgcacagtttcctctttttaagggaggaggctcggagtctccggtcaccacagccgatttccctgaagcctccgcagggggccacccccacagagttttatatgctaacagttcttaaattcggagtcctgtgggaaggtgggaaagttaggtatatacactttttaatgtttttgtttttgtttttttgttctactcaaaaagtcattggtacctaggtaacacacttaaagaaaggcacactttgtggctgggcacagtggcttacacctgcaatcccggcattaggggaggccgaggcgggccagtctcgcttgagcccaggaatttgagaccagactgagtaacatagtgagaccgcatctctactaagaaaaaaaaggttagccaggcgtggtggtgcgcacctgtggacccagccacttgggaggctcaggtgggaggatcacttgtacccaggtggttgaggctgcagtgagccgtgatcaggccactgatctccagcctgggtgacagagtgagaccccgtctcaaaataataacaataaaataaaggcacattttgagaacagaagatgtttctgagtttcacatgttgccatatcctgtggacagcttatagtgggacaccagggcagatattgaagtttgatgtaacttgtgaatggcttaaaaagtggtaatttcttgggatcagaaagctgattaaggcaaggctgagaggagtcagcttgcctctcttccacagcgtccactgggacagttcaaccctatctgcgggaccaatctccaagacgtgagttggcacagccatcagttcgtctccatggatgtctccacgggcaacctgagctcccacgtggcatggtgatggttctgaaagtgggtgttccaggagacaggaagtgccagttccttaaggcctgggcctgtggtaaaatatgcataacacgatttaccttattagccattttaagtggtattgagtctgttcataatgttgtgcggtcatcacgactgtccacctccagaactctcttcatcttgtaaaactgaaactctgtccgaattaaacaactcccatcccccctccctcaagcctcagcacccaccgttctactttctgtctatgaatttgactaagtacctcacaccagtggaatcgtatagtattcgcctttttgcgactgtcttatttcactttgtatcaagtcctcaaatttcatccacgttgtagcatgggtaaatttccttcctttttaaaggcggaataatattccattgcgtggatagaccatattttgtatagtcgttcatccttcaatggatatggggttcatattagctgttatgaacagtgctgctatgaacatgggttcacagcatgcacatctgctataggttatctttgagaccctgctttcaattcttttgggggtgcactcagaagtggaatggctggatcacgtggtcattctatttggagttttttgagggagtgccatcctgttttccacagtggtggcaccattttacacccccaccagccatgcacgagggttcgtttctccacatcctcaccaacatttgttattttcggttttttctcacagtagccatcccagtgggtgtgaggcgcatcgcactgtggttctgatttgcattttcctcgtggttagcgatgtttcatgtgcttattggccatgtgtatgtgttctttgtagaaatgtttatccaagtcctttgcccatttctgagttaggttttttgttgttgttgagttttagaagtcctctgtatattatggatattaatccctaatcagatatatgatttgcaaatattttctcccattttctgggttgccttttttccctgttaatattgtcttttggctgggcatattaactctgcctgtaatcccagcactttgggaggccaaggcaggaggatcacttgagggtcaacaacctgggcaacatagtgagaccctgtctctacaaaaacataaaataaaaaacagcctggcacagtgctccatgcctgtagtcctagcttcttggggggctgaggcgtgaggatcacttgagcctaggagttcaaggttgcagtgagctgtaattgtgccactgcactccagcctgggcaacagagcgagaccctggctcttaaaaaaaatagtcttttggtacaaaaatatttattttttacgaagtccaatttgtctgtttttttcttttgttgcctgtgcctttgatgttgtatccaaggaatcattgccacatctaatatcatgaagctcttgccctgtgtttgtcgtagttcatttgtgtggctataaaggaatacctgaggctgggtcacttatagagaagagaggtctgtttggctcatggttctgcaagctgcacaggaagcatggcaccagcatctgcttctggcaagggcctcaggaagcttccgctcatggtgaaaggtgaaggggaagcaagggagctagtgcacagagatcagacagcgagagcatggggagcaagagaggggagcaggttcttttcaacaatcagttcttgtgggaactaagagtgagaactcactcccccgagaatagcaccaaactgttcatgaatgatccgccccacaacccaaataccttcaaccaggccccacctccgacactggggatcagatccccacaggaggcttggcagggccaaaccaaccaaatccaaccacagcagttttcttctaaaagtttgtttatgttgaacatttaggcctttgatccattttagttagtttttgtatatcttgttgggtaagggtccaacatcattcttttgcatgtggatgtccagttttcttagaaacacttgttgaaaggactgtcctttccccatcaaatggtcttggcaccattgtaaaaaaatcatttaaccatgtatgtgagtgtttatttctgggctctccattctattttatttggtctatatgtctgattttatgtcagtaccatattactttgattacagtagctttgtagcaagttttgaaatcaggaagtgtgagttctccagctctgttttttttttctttttcaaagttgcttcggttattcagtgttccttgagattccatagaaattttaggatgggtttttctatttctgcaaaatacgtcactgagattttgatagggattacattaaatctgtatattgctttggatagtattgccattctcacaatattaagtcaatacatgaacatgggatgtctttccatttatttatctcttctttaatttctttcagcaatattttgtagtttttattgtatgtctttcatctcataggttaggttaattcttagtattttattcttttttatgctattatatgtggaattgttttcttaatttccttttcagattgcttgttagtgtatagaaatacaactgatttttatctgttgactttccatcttcttactttgctgaattcatttattagttcctgcagtttttgtgtgtgtcatatttagtgtattttacatctgcaaacagagactttttttaagttctttctttctaatttggatgtcatttatttttcttgtctaatcactggataaaacatccagtactatctcaaatagaagtagtgaaagcaggcatccttcccttcttcctgatattagacaaaaagctttcagtatttcaccactgaatatgatgttctttgtgggtttctgatacatgtatttcattatgttgacatagtttcatagtttgttgaatggtttttatcatgaaaggatattggcttttgtcaaatgcttcttctgcatcaattaagatgatcatgtggtttttttccttcattctgtaaatgtgtattacattgattgattttcatatgttgaaccatccttgcattccaggaataaatcccacttggtcctggggcataatccttttaatatactgctgaatttgatttgctagtattttattgaggatttttgcatcagtgtttattaaaaatattggtctgtatttcataccattgtggtcagagaagttattttgtatgatatctatctttttaagatctattgaaatttaatttgtaaactaacatagtctatcttagaaattgtttcatgtgcacttaaggatgtgtaagctgttgctgttgggtagaatgttctgtatatgtctgttatatcttgtgggtttattgtgttgtttaactcttctgtttccttatttatcttttgtatgattattctatctattatagagagaggatattgaggtctctaactgttactgtattaatagaactgtctatttcttccttcaactctgtcagttttttgcttcatacattttgattatctgttgttaggtgtataaatgtttataatcattatatcttcttgctgtgttgaaccttctattaatatatgatgcccttgtctttgctcttctttgtctctttttaaattgtaaactctattttgtctgatattactatagctacccctactctgtttggttgctatttgcatggaatatcttttccatctttttactttcaatctatttgtgtctttggatctagagtgagtcttttgaagatagcatatagttggatcatatgtttttattcattctttcaatctgtgtcttttgactggagtcaaacccatttatacttaaagtaattactgatgaggaaggactggcttctgtcattttgctatgttttctatatgccttagagtttttgtcctgcatttcctacattagtgtcttttgtgtttagttcatattttagtgaaatgtttaaatttctcatttctttttgtatacagtctatagctattttccttgtggttaccatggcattacatttagcatattaaatttctaatttggattcatagcaccttaactttgataacatacacaaactctgcttctttatagctctgtccctacccttttcagttattaatgtcacaaaattaaatctaaactaataattcttttaagtgcattagtctcaaattatgtagaaaacaaaatgtggaattacaaaccaaatttacagtagtgctagttttgactaataactttttaaaaaagtattagtatcttaaatcatataggaaacaaaattgcagttacaaaccactgtggcaataatgctaacttttataattggccatgtatttgtttttattgagacctttatttcttcatacagcttctagttactgtctagtgtcctttatttcatcttgcaggactccctttagcatttcttacatggaaggtctagtgataacaaactccctcagcttttgtttatctgggaatgtcttagtttctccctcactcttgaaagacagttttgacagatataggattcttgtttgtttgttttaaattttattttagcacttggaatatattggcccactgtcatctggcctccaaagtgtctgatgaaaaactggcttgcaatctaatagaggatcctttgtatgtgacaaatttcttctctcttggtgctttcaagattccagagtcctcctggaggtggagtgtggagggcacatgtgggtgcacacagtgggccacccagacccctctcagcacaggggtttgctagcagctcacagctgagtctctttcccagggccatccctccttagggtcagcctccatcccaggacatggagccctgccccctacctcaactgggacaaccctctcccctgccctgccctccaacaaagggtactgccagaaagaacctccctatactggattgaatggtgtccaccaaaatcgatgagcttcccggaacttcggaatgtgaccttattaggaaataaggcctttgaagaaatacttagttaagatgttgtactgaagtgtatgggccctgatccaatccctggtgtccttatagggagacaagagacacacagccacagaggacaaggccatatgagatggaggcagagactggagagatgccgccacaagccaaggatgtgtggggccaccaggagctgggggaggtgaggaacagattctccagagagcctgtggagggaaccagcctaccaacaccttggtgctgggcttctggcctcagaactcagacagtgaatctgtgttgtttgaagcctcctagtttggtccttggttacagcagccccaggacactcagtccccagcagcccctgcagcaaatctcagtgtctctccccccatctgtttgcagaggccccatcaacgaacaaatgcagacaactcttcctggagttttgcattaaagacaagaagctgggggcacagcgagggggacatgaggtcaaggcgctgctgctttgttaggtaggggagattgagcatgtttgtatcctgatgggaatggacaagcagcaggagcatctgatggcacagcaaccagggggccaccccttaaggacaggtgggccggcttgccttggagcatgggtgcttgctcacaggctcggggcaaggcacagatgcgggaggcacagacgcggcagtgggagcagctgggtccatcttctcccagctctgggcacaggtgggaggcacagtgcgtgctttccctgcaggcttcctgtgcttcgccccgagccatctccccaggtctgagttcctctgctggtccaggagggtctcagtgcggtgggacaaactcgttccattggtggatggagacacacccagtgtggacagaggctgcaagcatcagagggcgtgtccatgcggcagtattggtgtcatggccataaggttggcacttcctacagactccggccttgcattttcagcagctggagctgttcacagcatccttctcacaggagttttgggagcacaaccaggtggggtatgcttgaaagccttagagtgaggaccagcacacccaccctcctggtgtcccatgcaaagctgctgaaggggctgctgtggctgaaatctgagctctgggtggtgcctgcaggagcccaagcagctccagagggagccccattccacttgaccccttttccttatggcagattcagcttccctggggtgaaatcgaggggcatttcccagttatctccaggagtatgaaatttccctcttgtttctgcccacctgaggggctgcacttggaccctgccatgggaagaggtctgttcctctctgcctcctgggggaccccctccttgtgtgagtcccctctgaagccctgcagaacctggtctgggtcctgaacagtcctgccgaggcctggcctgttggacacagatgctcaaaatctactcagagcatgctggcccctgtggagtggttcctgttcctggggggcttaagtgaatgagggcgagtgattcctttaaacattctttatgtgctgggcacagggctaggggctcaggaaccaggcgtgcgaaaccatgcatggtcatggcctcaaaggccgagctcaccatatgtggacacacatggacaagggggtcactgacctgggaaggctgtgaggggcactggtcagggcaggaaggccttcctagaggaagtgagtcaggtgagaagaagttaaggagcaccgttcctcttcttgggaccttgggcatgtctgtgtccccagctgtagcagaataaggtgccatctatggatgtggtgctgtgtggtctcatgtagccccatccacggcctgaccttcctgaaatccataaacgctgagctacagatgtcacatgtgtctaagatcactggacagaattagcatgcctcaatgaaaatgaactacgtccccaagtaatggcacgattgcagttaaacttatgcaacttcagaaataacggcagataaagggctagagacgtagaaaccgtggctggcatgagggaggagcttagtgagccatgggatgaaggaatgtggtgcctgcaggagcccgagtggccaggagccctgctcttcccaccgtgggactcctatggcctccccaccactccagcctctgcctggggctcctctagcccctctagttgggagaggtcatcccccaacagagacacaaagtatcaaaaagacaagcatgcttttgtttcctgtttccgtcaggtgtttctctgatccgtaagagcctcctgcccgttcatccatcaacagcctctggggacaccttcggcagcaggaatcactggtgttgggtactgagtttgaatttctgtgcccacctttgcgctggcacaaaggggctggctatgtggaagcagaatgtggggcccttgctttaaagacctcagaggctggttgaagggataaacctcacacccccaaaattgagagaaaacatcaagggagctgcaccgcagcaccaccttgctctctgggcttcagcaccagggaggcggacagctccattcactgtggccgccaccgcccatccaggactccagccctccccgcatcatcgctctgcttggctgtcgggggaggagagcggctgctgctgtgcatgggtgcttgggggcggtggggggtggggtgcagaggaggcaccaccctacccggggccatcaccaaccaatggggatgggagcgggtagataaatgccccagcctccccagcgtcggtggacagtttggaagtgcattcattctccatggcttcccagagggcccccagcaggcctgagcagcagctcttgtgaaactgccctccatgggctgctctctcttcctgtctcactgtgtgctccgtccctcacttcagcttcctggtctcacatcccaaacacactaccttcgtccaagtccttgtctccaccagggcttacatttggggtgcctagaaaaggagagagcatataatcaatgccagggtgagtggggggacacccagagccatgaggtcccaaggagggggcgatggcagggtggcccgtgaggcaggtggtctgggcccaatccccggctcaggatggacagaaggcaggagcagcctctgtgggggctggtgacagtgtgagctggcccagcagtgggtgggcttggctccaagggtgccacagggactgtgaagcaggctggagagggtggcgagcgggcctccagtgggaaaaccaggcatggcactgaggcgggcaggtaagttcagccctacactcctcctccttccggccggactctcacgtggatctctccttctggctgtgcaggttggatctatgaacacgagacacagaaacaccagctggaggagcccaggaggcccagcaggtgaggttatccacagaataggcacgccgccctagtccatggatcactgagtgcccagaccagggcttcagggggttccagccgaggctttgtgaaccggatcctgggtcactgagtaaccagactggtctcaggaggttccagctgaggctttgtgaaccagatcctgggtcactgagtgcccggaccaggggttcaggaggttccggccgaggctttatgaaccggatcctcctctttgcgtttcaaacagcgggaaccatcttagtccatgggccactgagtgcctggaccaggggttcaggaggttccggacgaggctttatgaaccggatcctcctctttgcatttcaaacagtgggaaccatcttagtccatgggccactgagtgcccggaccagggcttcagggggttccagccgaggctttgtgaaccagatcctgggtcattgagtgcccggaccaggggttcaggaggttctggccgaggctttatgaaccggatcctcctctttgcgtttcaaacagcgggaaccatcgtagtccatgggccactgagtgcccggaccagggccccggggcttcctgacagcaggaacaacaggaatcattcaaaccctggagcccagagggcaggacgggagcggccttttgtcccccgcgggcaggccagggaggtggacaggccgggagcctgaagcctgagcagctggaggctcgctcattctcccgtggtcactgtgttcccggagccccaacagagggccaattgtcccacggggcggtgcctggtgggtgtggtgtcttggcggcagccactgcctggctgttctcaggatcccaatcccaggtgaaggctgcagtcctcttgctgtgtgtggactatttagctccgtgggcggccaccttgccatggggccacagcagccattccagaggctcccccagtgccctcctcgcccgggggggggtgctcccgggtgtggtccggctgaggagtctcactcgcaggaaaggtggcgtgtgacgggctggagccggcctgcgaagtctgcctggtggccatggctcaggggcctgtgtctcccggacgcccccagcggggcctctcttgaagggactttgtgctcctgccaggagaaaacagccctaacagctgcctcctgggccatttccaaacattcgtgtgtcaggccagagagcgccagttcgttgcccttttgggtggttccaaacgtgtggagttggggccctggcagcttcggaccaccagccccccttcactgaggggttcgtcatcaccaagcctcagccagagatgttaaactggaaaaacaatcacggacccccgtgggggaagcagcttctggtctggggacagtcatgagctctgcatgcagctgccggtgtcccttctcggtgcctggcgggtatcagggctcacccttggcctggccacacctaccgcctctcaggcccacacctcttcccggaagacacctggaggcttcaacaccggctcacgccctttcctggaagaaacctggaggctctgacgccggcccacactccttcccgaagaaacctggaggcttggacgccggcccatacccatttttggacaccgggggcttcaatatctgtggcatcagctcctcagctctctcttccctcagcatcccactgacccgaaattccaggagatcccgagatgggccaaacacaaaac

SEQ ID NO: 1323 - DNA, 24380 bp, Homo sapiens
accgcctcttgtttttcccgcgaaactcggcggctgagcgtggaggttcttgtctcccctggtttgtgaagtgcggaaaaccagaggtgaggctagtgggagtgggactgggactgggagccagcaggcatctggatttccgggtgtagttggagtgggacaggagtttctcgggaactggggttggagtccgggagcgcggccgggggtccccctgctccggactcagggcagggacccaggcgtcggaggggaggaggtgccaggcgctgcccccagcctgttctggccgtttgttcccaccccaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacaggtgcggctcctgcggggccgggggctcgagttccagtgtggccgctcacacgcctctaccagcctgctagagtcctggacagtcagggcacagatgggcccagacgggggaaagagccggtcctgggtcacagggctcatcccggcagcctcacgccttggtataaggctttgtgtattttgttttactttattttattttattttattattaacgtatttgtttattattttgagacggagtctcgctctgtcgccaggctggagtgcagtggcacgatctcggctcactgcaacctccgcttcccgggttcaagcgattcttgtgcctcagcctcccgagtaggtgggactacccccgccatcaccacgcccggataattttttgtaattttagtagagatggggtttcgccatgttcgccaggctgctctcgaactcctgacctcaagtgatccacccgcctcagtctcccaaagtgctgggattacaggcgtgagccaccgtgcccggcctgctttgtgtattttatctgtacctggagttaacttctgggtgagtcacctgttgagtgggccaccagcaaccagctagcgccacttggaccgtttagttctttatccagatcttgttcctgttcatctgcttcctatcatccttccatgtcatgtctgagaccttacaaactcaagttccctgtaggtgtaaaaggtgaagatggcagttaggattcacttcacttcgctcattcatttatttataccagtcttgcaccttcattgattgagcacctgctgcctgccagatactgttctgggtgctgggctgcagcactgaagctggacctggctcctgcttctaggtgattgtacgacctgtgacatcatgagaattctcataggcccggcctctatccctgaaatgttaaaatgcagagaacatgaggttgcaggttcagcactggcccattattagctgagtgacttccaggtgtcagtgtctctgggcctcaccaggccagaaatgggtaaagccattcctgctttcacttactcatgcagcagctgatattgcccacctgtgtgccaggcactgcgctacaaagatgaaaagacgtgcttcttgtcctagagaagctcctaagtcagaggagtgagtcgtgaagaccaacagataacttccacggtggtcatttcctccacagaggaaggtgaaaggacttagggaagttttccggggggctgaagtttgaggggacctttgagctaaggtcagagttgcaggtgtagaaagctttctgtctaggtaggagcaattgcttgtgtagaggtgtggggtgtcctcacagcaagtggctttcagtagcagtctggccattttactggctcctggacataagggagacggggctcaggcctgtgatactgcgaggctggggaacagcctgtgcgttggtcagtggtccccaaatatgttcttgccacagcagtcacatgggatgctctgctaagcatctgggctggacgcagtggctcatgcttgtaattccgacgctttgggaggctgatgccaatggatcatttgaccccaggagttcaagacctggctgggcaacatagtgaaacccaggctctatttaaaaaaaaacagtctgactagaggttgataaggcagatgtgttttctgctgccttggtgcctccagtttttttgttgttttgttttttgtttttttttttttgagatggagtctcgctctgtcacccaggtttgagtacagtggcgtgatcttggctcactgcaactgctgcctgccgggttcaagtgattctcctgcctcagtcccccaagtagctaggattacaggcatccgccaccacacccggctaggtttttttttttgtatttttagtagagatggggtttctccatgttggtgaggctggtacctttttggtttttttttttgagacagagtctcagtctgtcgcccaggctggagtgccctggcgagatctctggtcactgcagcctccacctctggggttcaggcattctcatgcctcagtagctgggactacaggcgtatgctaccatgcccggctaatcttcgtatttttagtagagactgggtgttgccatgtggcccaggctggtgttgaactcctggcctcaagtaatccaccctcctcagcttcctaaagtgttgggattacaggcatgagccacctcactgggccccaagtttgagctgtgtgcattgttcttttccaagagaagttaaaggctctgcggagtccttcagtgacagaactggtttgttgttttgtgcacgctggcctgggtgttgaaacatcctttgactgtcttgtggaccccttccatggagctttctttagggcatgcctgtgccagcagtgagtagcctctgcagggttaaataatggaatgatctggaattagatgtgtgtttgggaagaggaatggtgaggtcatggtggctgtggtgtgggcagattcaggggtgcaggcacacctcagccagtgttggtttcctcttctttgcacccttcctgccccaccctgctatgtgcccactccagggatgaactcaagcggcattacaacctgggggagtactggattgaggtggagatggaggatctggccagctttgatgaggacctggccgactacttgtacaagcagccagccgagcacctgcagctggtgagtgggaccccatccctgagcttcccagggctgctctgccccagttactaatagcctgtgcccttccctttctccagctggaggaagctgccaaggaggtagctgatgaggtgacccggccccggccttctggggaggaggtgctccaggacatccaggtcatgctcaagtcggacgccagcccttccagcattcgtagcctgaaggtgggtcggagggcagtggctgctgcatggtgcagagggctttggatgcagccagacctgagtgctagctgtgtggccttgagtgaggcacttgacctttctgaacctgtctcctcctggagacaaaaggatcgtttgttgttttttgctttttgttatgaaaaattacacacccaaaagcagagagtagtataatgaatcccataaagcttcacccagatttaataattaacattttgtgttgtttcctattttgtcctttttcttttttgctaaagaattttaaagtaaattcatgcacagtggctcatgcctctaatcttagcactttgggaggccgagggaggaagattgcttgataccgggagtttgagaccctggctctccaaaaaacaaaacaaaaaaaaaacaaaaaaaacaaagctaggtatgctggcatatgcctatagtccaggctacttggaaggctgaagtgggaggatcaaggggcctaggaatttgaggttacagtgagctctgattgtgcctctcagcactttagcctgggtgacagagcaagaccctgtctctaaaaataaaaaataaattacagacatgacactttatcccgaaaaaaaaaagttttcttacatagtctcattagcacctcaactgaaacatcaaagatctcttagtatcattgaatatacagtctagattcagattgaccaaattacctcacatgactcttacagctcgtgtgtctcagccaggaccaggcattgtactggattgttgtttaaatctcttttaatccaggacagcttcctttactctgggtgtaagttctttcacagatacattattgatttgctaaagaagcaggagccattatcctgtagaatgtgctgccttttagatttatctgaaggcctccttggggtggttacaacataccccttcccccccgtgatttttggaagctggaagttagatgcaaaggcctgactgtgtttcgatttcacataccgggcaagaacgcttatgggtggtattggatccctcattgcatccctccatccactatgctgagactgaccaggtgctaggttgaggtggtgatggtcactttattgtaatgatgcaggcatggagtcttgaattccgcctccccagcctcgcttctgcttcccacagcctcttcctgctttctttgagagccccagcaaaacttctgctcatgtctggttctctcgttcagccggaggagggcattgagaaacggagacaaggtggagagagattgtcccagtcctgtacactagtggctcaggagctttgtgaagggcaagggctggccataggaaggagtggatcggctgagaatttatgttttactttttattatggataattcaaacattagaatataaagagaatcgtataacgaatcctcttgtactcatcacccagcttaataattagcaactagaggccaatttttttttttttttttttttgagatggagtttttgctcttgttgcccaggctggagtgcagtggcacgatctcagctcactgcaacttccgcctcatgggttcaagtgattctcctgcctcagccccccaagtggttggaattacaggcacacaccaccacgcccggctaatttttagtagagatggggtttcaccatgttggccaggctggtctcgaactcctgacctcaggtgatccatagatgccaaatcttgtttcatctgtggccctggagttcttttgaaacaagtcccatacatcatataatttgatctggaactatttctccatgtatctctaaaagatgaatctctttttttttgagacggagtttgactctgtcgcccaggatggagtgcagtggcatgatctcagctcactgtaacccctgcttccccggttcaagcaattctccggcctcagcctcccgagtagctgggattacaggcatatgccatcacacctggctaatttttgtatttttagtagagacggggattcaccatgttggccaggctggtctcgaactcccgatctcaagtgatccgtccgcctcggccttccaaagtgtcggtattacaggcgtgatccactgcacccagcctttgaagagtcatttttaaaggcatagctacaataacatcacacttaaaaattaacattacggccgggcgcggtggctcatgcctgtaatcccagcattttgggaggccgaggccagtgaattgcctgaggtcaagagttcgagaccagcctggccaacatagtgaaaccccgtctctactaaaaatacaaaaagttagctggacatggtggcagttacctgtaatcccagctacttgggaggctgaggcaggagaatcgcttgaacccgggaggcggaggttgcagtaagccgagatcctgccattgcactccagccttggcgacacagcaagactctgtctcaaaaaaaaaaaaagaaaaaagaaaaaatattactgccttattgtccggtgtgggaatagtcattaagatggggaaactgaggctcaaagagaagtgacccagacagaagaccacacagcaggttttgacagaacttgaactagaatgtgggcccctgcctcccaggtttgttctgtgttgtactctacaggtccaaggatgtcgccatcagagctggggtcaggtctctctcctggcacctgccactttgtagtgaaatgtgcttagtgtatctcttgccctgccacctccccccccaattgtgctgcgaggtctttaaaagcaggagctgtgcctgaggctcctctgaaccccagggtccagatagcctggcactgggtggatgctctggaagcattttttgagcggaacagaagagctgtggccctccctgcagctctgtgcccacctcctccaggctcctgcccaggatatttactggcatatctcagatgcgtcctggctccccttaaccaacaagcttcccgatggctctattacagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacgtgagtctgtggcccagagggactgtgggaggtgacctgagtgaagatcagaaaggatgagaacaagtagcaagcactgcctgcagctgcttctagagatccactgggatgggctgggcaggggtgtgcccttaggattggcacagatctgatgccctgtggctctgagacaccatgaacagggtccctctacattggtgacttctgtctcaccaggatacccagacagcgttgtagggaacccagggttgggagggaaaagcagtccagggtaatgagtctacttggaatcttctgaagcaaactatggtttgctcactaggccagatctagcctgctgaccctatggcccaggaacacgttcgttcatttaagtattgcccacagctggtttcgcactacaaaggcagggtatgtggcctcttggctggcagaacctggaatgcacatcctccggccctttctagaaaatgtttgctgcccccagtctgaaggaaccccaccctcttcactggctgctctttcttggctccttcgctggtgcctcctcagcttcccatccacctgtggcacagctgcctcattccatgctgttgacatctctcacttggagaggcacgctacctcctccctgatcccccgcgtccaccctccaccccctcagtctgttttccacccagcagccaggtgtcccttgacactcaggtggtccagtcatttacttcttagtcaagtcctgcacagcccaccacgatctgctcctggcttccccaggcctcgctgcccctcctctctccaggcccggcctcactgcctccttcctgtttctggaatacactgactacccccagtctcactgcctttgaccttgctgtttcctctactgggagtgctgttcctcaagctaccatagtctgtgtcctcacttcttcaggcttctcttcacatgtccccttaccaggggcatcttgcccaacccttcatcttcagtttggtgtgcacgtacctcgtctctcccacacctgcctacttttttacttttcttcacagcatgtagctgtcactctttaatatgattgtttgcttgtatgtcttttcagcctcccttgataggaacttaggctccacaagagcagggacctttttgttcagtgctgtgccccctgcacctggaatagtgtcagacacatagtaggttttgctatgatgtttacttctttatgttgctataatatctattgaataatgacataattacctagggatacgtagaggcttagaccctcagaatggtctagaactgcctagaatcccactggaaaagatcttgggatttgagtggggctttagtaagagaattgatgaactagctcttcacccatgaggacaccatgatcctgcaagaagaccgagtgtgacctgtctgcctcctctcagcaagttaatggaaggacccagcctcaagcagttcccttgactcttaatccagtgctaggtccgtcagtgttgccttcctttcttacctccaggcagcgttgcctgcctggcttatctccagcttattctggagacccccataaattgccgctggcaacgtctccttgctggctcctgggatgaatgagccctgcctttggattctccaggtagctttggtgactcttttcccttaccttgtacagagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtgaggcagacgggctgggaggtgggcatctacgacggtggatgtcccagctgtggccctaacccgagtgttgggagtgggtcatctggagcagggtgagtagggtggagaaggtggccagttgcagagcacctgctctgtgcctaatgcttccataagttcctctcatctcgtctttccataatctgcaggggcatgtcagccccattttgcagatgaggaaatgtaacttggagagattaaatgacttcctgtgtggaggagagccgggctttcagcctatgtgcattgctttccaaagtctgtgttcttcttaggataagaggcccaggatgcacagctagataaccaatagctggcaaagcctcttcccagcctgacaccccacctcctaccccaggctttctttttttttttgagacggagtctggctctgtagcccaggctggagtgcagtggcgcgatctcggctcactgcaagctccacctcctgggttaatgccattctccggcctcagcctcccgagtagctgggactacaggcgccctccaccatgcccagctaattttttgtattttttagtagagatgaggtttcaccttgttagccaggatggtctcgatctcctgacctcatgatccgcccgccttggcctcccagagtgcgtggattacaggcgtgagctactgcgcccagcgtaccccaggctttctgttaagatcctgctgaacagccacggtggctcatgcctgtaatcccagcacttggagcggctgagacaggaggattgcttgaggccaggagttcaagaccagcctgggcaacatactgagaccctgtatctaaaaaaaaaaaatttattagctgggtgttggggcagacacctataatcccagctacttgggaggctgaggtgggagaatcacttgaccccagaaggttgaggttgcagtgagctgtgattacaccactccactctagcctgggtgacagagcgagaccctgtctcaaaaaggaaaacaaaaaagattctactgagggggagagggtactgagcttgggcccctcatagtaacctgggtggaaggttttgagatctttgattagggttctaacctgggcttgcatatcctgaaattgcatgcagatgttctgaggagagcggatctgtagcttctgttaacttcattagtggcaacagagtatgtaggggtcaggctcttgctccctgggcaagttatgtgactttgtcaagcttcagtttcctcatcagtaaaatggggataaggacagtccttaatctctcagagggctgcttgaaaatgcatgtggtgtttagcacaattccttcatgcagattacgtaatcaggatgtatgattttccaagcagttcatgaatcctgaaaacttacgaagtgggtatgggaagaggggagttggaggctcatggagtgacggtgatggtcttttctggagctgtgatgcctgatggtataaagcacttctatgtctgctgcctcacctgactccacaacatgagaggcaggccacttcgtcatccccctaggctcagaggtgcaatgacttcgttgaggtcacacagcgactaagtgtccctccacaccaccctgtctctgactgggggacttggagacttccctgtttcaacatctcattttgaaaacaggaaatgaaaacccagaggcaaaatgagctcacagagccatgaagaggcaaaaagggcgagtggcccctcaaggaggctggggggcgtgaagaggaagtcttgccctgagaggctaaagggcaccacacagtgagctgacagcagacacgtggagatggggcttttggagggctctgtgggctggcactaagcctcctaaaccagcgtacaaatgagttagcgagttcagcgagagtcaggccaccacctgcctttctgtttggctgtcactgtgggcaacaccatcctccaagcagctgagcatgggctgagtgacgtggggagagaggccgttctctgggctccgtggggctggagccagctcagcatgtggtgcctgtggcaaaaatgctgcagtggaccctgcgtgtcctgggcatgggtggaatcagagacttgctgtccaagtcagaatctcagcttttctcctttctcctctaccctcctctcaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggtgagttggctttggggtcctggcttagccctgctaaaaggctgtgcttgcatacttctggtaacaggcagctcgttacttcatgaggtagcccaggatgtccttgtgttgctcatatcattagaacgttcatttttatattaagtgatccctggaacttccacacattggtcctagctgtggctcctgggctgagggtgtttgcctaagtgcaggattaaggcagaaggactgaggtcaaatcactggggaattactgaaagccaagtcttcacttctgtgacaggaaatacaagagaagtgaaacgcagggttccaggcaggcagccgcctagtgtctagttggagaaataagaaaactgtgagaccgctggggacatgtgggtaaagtggtggctgttgtgggtcacgcagttccaaggaggtgctaaaggaggtctgagaaggaggaggtcggggctgggccttggggaaggttttctgggaggaggttaatctgagctgggctttgaagagtggtggatgtggaagaacttccaggcgggaggggatggcaggagcaggtgaaaaccccggcctgggcaaggtactgagtggctggagggccgagtgggagtctaggggatgaggggccaggtggtgtaagaggccttgagtgccgagatggggagctcctgcttacacctgagggcagcaggggccactgagggttttcaggtttgtttcagccctctggctgcagtgaattgattcagaggggtggcttccccagggctcagtccatggcccaccccacatttacacaaactacctagattattacaactttaaaaccactgacaggtaagtagctctcacatttccatttctagcctgggcttctccccacgttccagactttaataaccaactgctgatttgacatgttcacttacatatctgaaaggcatctcgaactttacatggctgaagctaagctcccctttccccaccctcagactggctcctctcagtcttcccatcttcaccctttcagttgctcagacaaaaacccccaagtcacccttggtgctcttttctctcatcccccacatctaatcactcaggaactctggccagctccacctttaaaacgtgtccaggatctgaccacttctcatcctccccacctgctctgagcccttgtcagccctccctggatcaccgttgatcctccccagtgttcgtctccaccttgccctaccttctctgttctgcagcagccagtgagcgatgctgtcatgaccaagacactatatcactcctcggctgaaaggggagaccttccagtggtttccaaggtcctatgccatctggccctctgtttgctcagaacccttctccccacttcccctcaccctttggaccctggaacacaccaggcccattcctgagggcttgagagctgggatctctgtttactcagataggttgtgctgtcctggccctaagggccctaagggctctgccttctgggaggtccctgagctggtgccaggatgggcagtgggctggaagagctcccttgtactcactcatgcgcctgctttgcctaccaaggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggtaggggcttgagttcccttgggtttggggaggcggctgatgatggggctcacagtaggataattactggataatcaggactgggcactcttttttgtatttcctgggcccctcagtctgccaggcacctttgccagcccccaagcttgccatcagctggctagtggctgatctgcgcacctgtctcagcgatgccctgaccctggcaagggggagactgggggcctggcaagtgcagtgggagagcactgagcttagggtcgtgtaggtaccaggacttaaatctcagcactgagcttggggtcagtagcagggatattattagcagctgccatttactgtgttcttcctatgcacagccattctttgttttttttttttgagacagtctcactctgttgcccaggctggagtgcagtggtgtgatctcggctcactgcaagctccgcctcttgggttcacaccattctcctgcctcagcctcccgagtagctgggactacaggcgcctgccaccatgcccagctaattttttttgtatttttagtagagacagggtttcaccgtgttagccaggatggtctcgatctcctgacctcgtgatccgcccgcctcggcctcccaaagtgctgggattacaggcgtgagccaccgcacccggccgcacaggcattcttctaagtgctttatgtgtctgaagcccagtcattcctcacagtaacctgttaacgcagctgttgtgcccattttatagatgagggaattgaggcatagagagttaaagggacttgctccccagcacatgcaggggagccaggagcctgctgtcatggtgcttgttctgccgcaccgtgcacagcccacaggcagctctctgtccttttctttcaagctgggaggaacgttgctcagatgctgggtgtacccgagcacagccataagagccatttcctttaaccctcctcttctgggaggcaagctctgtcctcattgctaggcaagacctaccatggtttgggaactacagagctgggtaggaacatgggtctcaggccacagccactaccttcttaccaactctgaggcccatgatagttgggggagtcaactgccagcccaccaatctggtgactggatgtcacatgcgatgccctcatggattctcaccttgtccatctacccttcgtcccccaggctccctgatggacttactcgccgaggagacatcaacctgctgatgctaggggaccctgggacagccaagtcccagcttctgaagtttgtggagaagtgttctcccattggggtgagtggcctgggatacctttgccaccttggcttgcagggaggaaggctgcagggcagggcctctgggtcctcaggacacctgtggtgggctggctcacccggaatctcttcctcctttctcttggctgcggtcaggatggccgaggagatgggaggaagaagggagccaacaggtgtatgtaggtttggggcagggggcgagtacactgtactgagagtcaggatggggtttgggtctcaccctggccagaaattggctgtgggctttgagtaagtcacccaatctccctgagcgtcagtttatccatttgctaaataatgatattgttatcattaatagctaaaatctggctgggcatggtggttcatccctgtaataccagcgctttgggaggccgaggtgggcggattgcttgagctcaggagtttgagaccagcctggacaacatggtgaaaccctgtctttaccaaaaatacaaaataactagccaggcgtgatatgcacctgtggtcccagctgcttgggaggctgaggtgggaggatcacttaagcccagaacggggaggttgcagtgagccaagattgtgccactgcactccagcctgggtgacagagtgagaccatgtttcaaataataataataaataataataataataataatagctaaaatgaagggccagacactgcttgaagtactttgcatatatttacttagtcttcacctcaactgtgtggcaggtactattacccctgtgttaggggtgagaaaactcaggtacagaatgggtaagtgtcttggcccaggtctcactgctggtaagcattagagcaggatgtgattgaacccaagtgtctgatgagctgggtcctctgctgcgttgttgaatgggtctgcggggatcagagccagagaaggtctgacatgatccgagtggcggggttgtatagggcgagatggtggtctttggatagataggaagtgtgccaaatttgccacactggcactgtccagtagaaatagtgaactgcacatgcgacccatgtatgtcttctcagattgtctaacagccacattaaaaagtagctgggtgcggttgtgtgcatacctgtagtcccagctacttgggaggctgaggtgggaggatcacttgagcccaggagtttgagaccagcttgggcaacatagcaagaccccgtttcaatttaaaaggaagaaggggaaagaaaaaaggaaaaacaggtgaagttacttctgtttaactcgctatatctaaaatctcatttcaacatgttgtttgatatgtagattattgagatactttacattcttaggagctctgagtctttgaaatcgtgcgtattttgcacgattaaggacatctcagttaggactttcccaatttcaggggctctatggcagtatgtggcgtgtaggtctatatagagacgacaagggactcacgatgggggcaggctttccctgggagtcaggagtcctcatcctagccctgaggctaactcctcttctctgggcctcagtttgctcatctgtgagttgggcctcacaagactgtgtcacagggctgtggtgaggcttaggtgagccatggatgtgatgccctcagcggggagaacatctgggcacaccgaggcccagggcagcatccccttccagagggagacgcactgagttggagccttgagtcctattctgtaccctgcagccagctttgatgtgtgaccttgggcaaatcacaacctcagtgggtctttttgtcttatgggggtcaaagcatggagttgttattgggccctgacaccaccccactgccccaggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaaggtgagtctgatgaggtgggtagtagccaaaaggtgggtggcaccagggtatgtgacttcctgtgctcagccagcagaaatcacctctgacttgggagacatgttttcaatccctgggccggtcactctagtaactgtgggaagctgcttaacctcttcaagcctcagttcccatatctgaagagtggggagaagaaaggcaagcccacacagttgttcccatgattagaggtgacctggttgctgccattggccttgcgtggagctggtattcaggagtgagggctgctgttagttttcctgtttctactgctccctgctccctcacttcagtaggtctgatgatatttctctcttccccacttagatgcgagaagatgaccgtgtggcaatccacgaagccatggagcagcagaccatctctatcgccaaggtgagtggccctccatggagagcccagcctgcagcagcccagcgtggcccaaccgtcctcaggctgccctgattgggaccaagttctctttgcccaggcctagaatctgtgtgtgtgtgtgtgtgtgtgtgtgtgtgtgtgtgtgtgtgtgtgtgtgtgtgtgtgtgtaaacgtgtatataagaaggcatctttgccatctcctcccccttttcgtcgtctgtcgcctgttaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtggtacgtccaggggcagggctggtggccatgggacctgcctccaggcaggcttgtgattgtgtgggaaggagaatggagaacaagggccttggctggcaaagtcctgactgtcaggctgtgaaattggggagcacgtgagagggcggttgttgtggactgcagaggattgaagcagggtctggagtcctgtggcctgctctgcctctgccgtgagtgataagctgtgtgatttgggctaaatcagtttctccctgggcctcagtcccttatatatgaaacagaggagttgacattgggttatgagtaatagaacctcagttctggttagtaaatttttcaaagaaaaaaacatagtggtttatagaattggtaagtccggcggcttaaggcccaggtagatctggattctcaaacaactgtctctgcctttctgttctgcttcccttggtggaatctttgtacttgggcagctgttcctcttgtggtggcaaagacaaaataagattttgtcctgttagcttgtagcttaacagcccccaggaaagaggaggccccgtcttttccagtacttctatcaaaagtcccaggatagactcctattggcttgggtagatcctatgtccatgcccaagttggggtggacaagatacatgccccaagtcggggtggacaagctgaacccacccctttatggaccagggcagaggagcaaggagcattaagttctctctaaaggagaatccagatgctcccatcagaacgagggcctggtgctgagcaaacaggctgagcacgcctgagatctcagcaccctttccggctccttgatgccagggccccatcagctctttctggctgttccacctcagtgctgggactcaggcttgggacggcctgtgggatgacccattatcccctctgctctccagatgctggccaagcatgtcatcactctgcacgtgagcgcactgacacagacacaggctgtggagggcgagattgacctggccaagctgaagaagtttattgcctactgccgagtgtgagtcctggacgcaggcccacgggggtgaggttgcccagcttccctgggtgggagagaacccagtcccctggtcctgctcctcctcatgaagaacagcccagatgttgctgttctgaggttctcagctctactgaatctgctctgctcccttctaaccttgcgtagctcactggctcttggcttcagttttcccacctccacaccaaggaggtgggatttagatggtcttgaagacctcctcgagtctgacatgcagggaggcagtgaagtgtagacatggtagacatgggctctgggtcatacctgccttcactctatgactttgggcaagttggttggcctctctgagccttgatttccccaggcctatcgatgtttgctaggatttttgtaaggattgcacaagatgatgagtaagtgcttggcatagccctgccctgggtaaatactcagtgagtcgcagctgcaatttgattgttctcacagattttcaataataataattatatacatagtactggctggttgcagtggctcacgctgtaatcccagcactttgggaggcggaggcaggtggatcacttgaggtcaggagtgcgagaccagcctggccaacgtggcgaaaccccatgtctactaaaaatacaaaaattagccgggtgtggtggtgcacacctatagtcccagctactcaggaggctgaggcaggagaattgcttgaacccaggaggcagagattgcagtgagctgagatcgtgccattgcacttcagcctgggcaacagagtgagactctgtctcaaaaaaaaaaaatatatatatatgtgtacacacacacacacacacacacactcactcttacacactactttctttgtgccaggcattctgaattactattcagtattttctatatgaataaattataaccctcccccaaaacctaccaggtaaggtgtgctattattcccttccctttatggatggggaagctgaggcaaaggaagttaagtaacttgcccaaggtcacatgccagaggtagtggagccaggatgtgaacccagctgcttgcctccagaggctgtgctcttaaccacagtgcttcgattcttgtcgtacagcgctttggtgatcttttgaaggagctaaaacccaggggttgagggctctttgaatgcactaccagtggggggctggtgggtccctgattcagcacctctgccagggtgagtgggtagtccctgggtcttcatccaagtctgagctctgtgtggcccagtcttgagaggcttgggcccacagctgtgagtcagggagccctggattctaatcttccctctgcactaagtccccaggtagccttggggagttccctccctccctctgggtctcagtctccacatccttaggatggttgagctaaggctttccctacatcagtgactgtcagttggcctgggggctagaggggaggggatgggatagggtagatgctgatcagacttccccacacctaccgtcccaggagagtctgaggtgctcccagcccctggactgcagtcaccgccaagcctcctgtgggtgtcatcagcttgtcgtgtcttcagatgtgttgggtggaggagtttgagactgctgcaaagcccaccacccagtgggcctccatgccgctgtgattgtgccattgttcattacatgtatgggggaccttgtggcaagacaccacacagcgtctaacagtggggaagaggcggttttcaccctgcagacgtgcctggcttttcttcacctgttttttaagagaggcacccatatttctccccagtgttgatgtttgtggcagctgcccacagccagatttcacttaaatcttttccgattgttgtcccccagcccatatgagtgggcagctgtggtgtggtgggaaagtgcatgtctgtaagctggcagggggctgggggaaagggtaggtgccctaagagtccctcctggcctcacaccagcctctccccactgtcctgcaggaagtgtggcccccggctgtcagcagaggctgcagagaaactgaagaaccgctacatcatcatgcggagcggggcccgtcagcacgagagggacagtgaccgccgctccagcatccccatcactgtgcggtgagcaggcgggcagggctgggccatggcagatggggcttgctttacacagcagggtgtgcttggcaaccaggggcagtggtccaggcttttcacttggcacaggcccatagtagctctgggcaggaagagtccctttggagcataaactatggcctccttgatctcaatgatgatccatgtttcttgatttaaggccgggcaaacctagacccctcttgtctgaatttggcctggcttctcccattgtaggaagcccgaagggagggaaggacccaggcctgggagtcaagagtcttgggtcccagcctctagcccactgtgtgactgtagggaaattacattccttctctggccctcagtgcttttagctcctaactctgttcattcttgtgactttgtagacaatacagtgggtaagagttgggatttacctggtttgaatcctgtctccagcactgactggttggaaatggatttggctataagtaatggtaaatccagataaagtagcttaaagaaataggaagttcatttctcttttctgtagcactgtctggaggaagatggtatggggactggtgtgaggactcctcaagctcccccttactcttagtccgagatggccgctagaacttcagccatcacctccaggcagcaggacaggaaggaaagagagcttcccttttaaaggacacttcatgaagtcccacacaatgcttggacttacaacttactgccatagattggtcacacaaatacaacctggtacaaaagatgtctgggatgtgttttagtggatcgctgtgtgccagactaaaaactggggttccaagctaggtgcagtggcctacattgtgatcctagcactttgggaggctgaggcaggaggattacttgaggccaggagtttgagaccagcctgggcaacatagcaagactcccatttctacaaaaaataaaaaattagccaggcattgtggtgcatgcctgtagacccagctcctcaggtggctgaggtggaaggatcactggagcccaggagttcgaggctgcagtgagctatgatcatgccactacattccagcctggtccacagagcgagactttgtctcaaaaaaaaaaaaaaaaaaaaaaaattgcagttctatgactaagatcaaaagggagatggattatggggacacctagcagtctccaccacagtcttaccactttgggcaagcacctccctggtaacgggctggctggggaggaagggaatagcggaccgaggctaccctgagcacgctgttgcccccacaggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggtgagcagatgcaggggccatggtctcaattgatctgggttccctggctcggagctctgtgggcagggctctggcctgctgggggcctgcagtgtgtgtcttgcttctctgagtttgctgagcttctctgagtttctttttgccataagacccctctcctcctttctccccaccgctgtttcctccaagatgggaagaagcagcttctctccagacccttgaacacaatcctcttgacccaggtcattgatgataacccttctcactggctaggaacaacagttgatgctctgcttcctagagcttgtcagcattttcagtgcttccagagttatttcttgcattttgccttacagctgccccctggaagccaggtgagcagtcagtcctgcccatgttagaaatgagacagctgacactcgaaggggcctttccctggtgcccaagatcacagtcgcttggctggaatgcaagtctcctggcccctaggccagcgttttccacaccataagccatactgtctggtttcggtcagcctttcaacagactgtcccaggcaccgatcatgagccaggctacctacgctggggaaaatctgttccttcacccagcagatacttcattagtgttactgtttgccaggcactgttctaggtgctgggagtataagagcaatcaatcacagggtcccggccctcctgggttctcattctcgttctagttggggagagatagacagtagagaaacaaatgcaggtagtgtaggtagtgaaaaaggcagtgagggagatgatggcagggccaggtgtgttggaaaaggaggacgtgctctttcccatggagtgagtgggcatggcctctgcaaggaggtgatgccaagcagggagctgcatgaaggggacagtgtggctccttgggggaagagctgctcaggtggaggcagcgctaagtgtcagtttccccaggagggagcaggtttggtgcatttgaatggggaggcacttgggtgaggaatggggtgggtggggcctgttcctcctgtcccccttggtgaagactcagcctctaccctggagacacttgctgtcacatgagacattgcaggtggaggcctctgggatgctgcaggcacagagggcaggggtgatatggagtggtgataatttgagttgggtcttatgggctatgtaggagtttgcctcacagactcccctctcaatgacttcttgaccatgagcccaccatctccttagctgaaacaccaaggcctctgtggcagtaattggaagtcacgagcctcctggttgccgagggctcctcagggcacctcgtagatgtgtccagggcaggctggcttccctcctgggtcactgatgggccccttccaactctctctctaatctatctgctccagcaacaaaaggagtcctgctgtggcctccaagggcccgcaggacttggtccctagtgacactctggccatgtctctgctgcgctgggccccgggctgctttttgaatgagacaggtgtgttcctgcctctgtgactttgtgcttggcctggagtgtccccacatgtgccatatcctgtctcctcaatcaggcctgcaccaccctggcacactcggtgcccttttctgacttactcttcggggcctggctcaggctgttcttccttgggctagaggctgtctctgtccaagaactcccattgtcccagctccccggctgcctcacttctccatgcccacaggggtggagggcttcaccagccaggaggaccaggagatgctgagccgcatcgagaagcagctcaagcgccgctttgccattggctcccaggtgtctgagcacagcatcatcaaggacttcaccaagcaggtgagcctgccttggagtgggggtgtgagccggcacggggtgcaggtcttctgctggttcccacccactcagcactggcatcttactcagcagacaggccctgaacgggggtaggatggacaactgtccctttctcagaccttttctagccatcattccttccctagggacatcttcatcaggagcagggatgggggtattttttctgtcccacgaaggggaggggagagcagaggtggttggattctggtgaaaccccatacaagttccccgcagcccttcccgtctgtgcctttccccgttggcgggcgtttcatggagtgggaaggggcagagccatgagagtgagctttctggctcactgaggagggtactgttggccccatagagagaagatgggatttcccagatgctctggaaaacctgtcacctttaaaatctcaggattaatcctagtttctggtctccgctccttgtacatcatctcattttgattcagggcagtttaatgggtggtatcgtgtctattctataggtgcgcagactgaggcttagagaaaggtttagagcttcggttctagagtcagatgggacttaagtcccagctctacctcttaattgctgtgaccttgagcaagtggcttagcctccgtgtgcctcagtgtctggtacacagtgggcactcaggaagtgtgggccctttaggtcaaaggagcctgagtacaaagttccccgtgagcctggggatgtctgggctctgtcggagtcccctcgggcagcacgtgccgttagccagccatgtgctcccacagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggta

SEQ ID NO: 1324 - DNA, 74593 bp, Homo sapiens
tcggatttttttttttaacttgggttttaattaggtacataaatagcaacatgagaatgaggagttctaaggcttgtacattatctctaggtgaagggattccaggttagtttgcttgtaggatgatttcacagaagataacagaggtctggtctagtttttcctgaagaagaaagccaatttaatacattcaatactgacttctatgccatttttctgtagaaatactgatttattctatggagtttccaatgtttacctataactaaaagaaagaaaagaaaaacataagtaactgtgccagaaaaaattttgcattatgaaaattcttcagatttaaatagagaaaccaggccaggcgcggtggcccatgcctgtaatcccagcactttgggaagccgaggcgggtggatcacctgaggtcagaagttcgagaccagcctgcccaacatggtgaaaccccgtctctactaaaaatacaaaaagattggctgggcatggtggcaagtgcctgtaatcccagctacgcaggaggctgaggcaggagaatcacttgaacctaggagacagaggctgcagtgagctgagatcatgccattgcactccagcctgggcgacaagaatgaaactccatctcaaaataaataaataaatagagaaaccatagaaaatatttacatcaccattatatgaccataagaaacatgagccagagaaaactgtaattattcccattttaaagacagttaaactaagaatcagaaaggtcgagtgtggtggctcatgcctgtaatcccagcactttaggaggccgaggcaggtggatcatctgtggtcaggagttcgagaccagcctggctaacatggtgaaatcccatctttactaaaaatacaaaaaattagccgggcatggtggcgggcgcctgtaatcccagctaatcgggaggctgaggcagtagaattgcttgaacccgggaggcagaggacgcagtgaaccaagactgagccactgcactccagcctgggcaacagagcaaaactctgtctcaaaaaaaaaaaaaaaaaaaagattttgtgttccatcaacattacatatacactacattcagatcctcaattggctgtgtatctgagtgtaattaaccaactagatggatgaataaataaaaaacaaatgcctaaatggcacagtacacatcacatctgaagattaaacaactacatttccatctatctgctggaaagcatgattacatcaccctcagtttgatgtgtaattttcctcgcatcacccccatcatacttttctggaataaaatacacatatagtcaaagacatgtcaaagacaaactgagtcttctccagattgcttttttcatattttttttttttttgagatggagtcttgctctgtcacccaagctggagtgcagtggcgtgatctcggctcactgtaacctctgcctcccaggttcaagcaattctgcctcagcctcccaagtagctgggattacaggtgcccgccaccacacccagctaattttttatatttttggtagagacagggtttcaccatgttggccaggctggtctcgaactcctgacctaaagtgatctgcttgcctcagcttcccaaagtgctgggattacagccgtgagccaccacgcctggctttttttcataatttgtaatgaatatactcagcaattagagatttttttttttttttgagacggagtttcactcttgttgcccaggctggagtacagtggcgtcctctcggttcaccgcaacctccatctcccgggttcaagcaattctcctgcctcagcctcctgagtagctgggattacaggcaggcgccaccacgcccggctaattttttgtatttttagtagagatgtggtttcaccatgttgggcaggctggtctcgaactcctgacctgaggtgattcacccgcctcagcctcccaaagtgctgggattacaggtatgagccaccgtgcccggcacaattggagatttctaaatattttagaggccagtgactattcacttgatcttttaatatacaaccaaaaattcttaaacatgtaaactactagcttattttttctatctcagtttattaatctgcttttgtcttccccaggaatttgatagatttattgcattgttaaaaactaaaaactggaaacaacctatgttggtaaggattaagtagatcatggtagtccatactaggaaatcattaagcaactagagaaggaatgcgtagctctattaagtactgacagggaaatacttacacaatatgttatgtaaaacaagttcattcattcatcagcatagattaatatagtactgtctatggcaaaaaaaaaaaatgaacctaagtctaattaagccttcggatccaactataagtttatgggaaatatagagaagaaagaaaccaagagataaacagaatgatactaaatggatacattcggccacagccagaacatgagaaattctttttttcccctcccagctcaatccttgtagaaaacaggaattctaaaggacaaataagccaggtttttcaacagataaatagcaagggacaatgagggagcggaaactattacagttctaagagacctatcagtcaaacacaacaggcagatcttgtttggatcctggttcaaacgaaccaactgtaaaaagttattcatgaaacaaccaggaaaatgtgtacattgaactggatattagatgatgttaaggaattagtgcaatttctttctttctttgagacggagtctctctctgttgcccaggctgggagtgtgcagtggcacgatcttggctcactgcaacctctacctcccgggttcaagcaattctcctgcctcagcctcctgagtagtttgaactacaggcatgagccaccatgcccggccttaatttcctttttttcttttttcttttttttttgagacagagtctcactctgtcacccaggctggagtgcagtggcgtgatctcggctcactgcaacctccgcctttcgggttcaagcgattcccctgcctcggcctcccgagtagctgggactacaggcgcacgccaccatgtctggctaatttttgtatttttagtagagacagggtttcaccatattggccaggctagtctcaaactcctaacctcatgatccgcccacctcagcttcccaaagtgctgggaccacaggcgtgagccaccacgcccagccccagcctaatttcttttttttttttttttccccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatgtatttttcacccaaaaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcagtagacgcagcaaagaaagcctaatttctttatgtatgataatataattacaattatatgccttcagtaagttttctgtgcagctactcagaagggtgaagtgggaggatcacctaaacccaggagttgaagtccagcctgggtaacacagcaagatcccatccccccagataaataacagtaaaaagaaagttttctgtgaacttgtaaaacaatatgtggaatatgatcccattttgtcaaaaaaccaaaaacatgcatgtatgcatgaatatattataaatgtataaataaatttatttaatttataaataaattttaaatataaataaatatatatatttgtttttgagacagggtatcactctgttgcccaggttggagtgcagtggagtgatcatggctcactgcaacctctttctcccaggctcaggagatcctcccacctcagcctccaagtaactgggactacaggtgttcgtcatcacactcagctaatttttttaattttttgtagagacagggtttcgccatattgcccaggctgttctcgaactgccagactcatataatccacctacctcagcctcccaaagtgctaggagtacaggtgtgagccactgcacccggcctatctatctatctatctatctatctatctatctatctatctatctatatttaaaagtctggaatgatataccaaactattaacaaaaattacctctggaaaaaagaataaaggggccagatgtggtggctcacacctgtaatcccagtactttgggaggctgaggcaggtggatcacctgaggtcaggagttcgagaccagcctgaccaatatgctaaaaccctgtctctactaaaaaatacaaaattagctgggcatggtggtgcatgcctgtaatcccagctacttgggaggctgaggcaggagaatgacttgaacccgggaggcctcagaggctgcagtgagcaagattgctccactgcactccagcctgggcaacaagagtgaaactctatctcaaaaaaaaaaaaaaaaaaaagaaagaaagaaaaagaaaagaataaaggataagacaagcttttttgttttgtttttgagacagagtttcactctttttgcccaggctagagtgcaatggcacgatctcggctcactgcaacctccgcctcctgggttcaagcgattctcctgcctcagcctcccaagtagctgggattacaggcaactaccaccatgcctggctttttttttttgtatttttagtagagacgggctttcaccatgttggccagggtggtctcgatctctcgacctcgtgatctgcccaccttggcctcccaaagtgctgggattacaggcgtgagccaccacacccggccaagacaagcttttaaaacagttagctaaaaacattttttacaaccaacacgaatcacttttataattaaaagctacacctcctccaataaagatctaaaaacaataaagaatgaagtcaaggttgtgtatttcagcaagctgaactctggtgcagagtatctttgaaaattgaaatggatatttacctaatttccctttattctatgtctttttcattgtccctgtacagaaatatatccattctggctgacagggatttaaaaaaagagagaaatataaccatattaaaagtcaagtctctagaggacatgtgtcactctgtggctgctcaccctccagtcatccttctaatggcacatcccatgcatatctggccccattcaccagagatactgattctggggtgccctttgccttttaccaagctccccgggtaatagtttgtatctgagaacatactgatgttgggttactgtatgaacagctatgctgtgaaagaggaactggatttgttttctgtgaccactaaggagacatatttttgcttagcagaggaaacagcttccaaaaactcagaattgtcccaggatggctgccccatagggtgagtttcccatcagtgctggtgtaaaagaaggaacatacagggtttcaggggagtctgcttgaggctgggggttgggccagataaccactctcaaattctcagtttatgtgactctttgggtctccaaaaatataaagaaagcttgaggaaaaaagacccttcaaactcagggttttcataaattttaagtaagggccatgatttacaataaatgtaacaccaattttcaaaaaattttctgattataaaatgcatactcattgcagaaaattttttaaatacagaaagttataaagaagaaaaaaatataaaaatcatcatgccactgaaagatacacactttctgtcgtatctcctggcttcatcccctctataaacatatcacactacctttttttcatttaacaataattgtgcacacgttcccatgcaattaaatactgtagaaacagaataataatattcttctttatagatataccataattaagccattttcctgtagttgaatatctaggttgcttccaaattcaattacagtcttctaattaccaggaaatcacaagtgctattatacaatttttcatatatacacaaacaatataactagtgttttgagcctctctgtaacagtcatgcattccagtgttcactgagtattagataaatacaagtgtacttactataataaagtgttgtttgaaaaaaacctaaggaataatgacacttttcaattgtttgaaatacatttgtagacaaatcccaactgtctggttctagcttgtctaaaaaacccaggtaacattagtggaacaaacacaaataagtaagtcacagcatttaagcccagaaactaaaagatggaataaaatattttcacatcaaattgaaactgttataattaattaaattaaattaattaaaaacaagtcatttcagctggcactacaatgctgaaaataatcacagaaatttcttgttttttacctgattaagatggcagagcatggagttttctacttagttccaggtgaattcttcacatttcctggcttttaaaacaaaagaaagagcttgaatgcagtttgaaaagaaatagtgcaactccttagtgtcctgagtatttggctgaacatgaacattaaaaattattatgggggacagggtcaaaccattttattgaggacttggggggttgttgaagaaaggctgaggaggacaatgagatcccacattctcgcagttaccgaccattaaatattattttactgcaaagtgatccatctgtcagtaaattgaagaagttactagggctctctgagggccctactgtagagtgacttgggcagagagagcaggaaataaagctccattaatcctcattatgcagattcagccaaacagttgattctaattaaaaaatcaatatatcttccttttatttcctgaaataaaggttttacacctatgggaaggcttcctgtaggtatttactccatgcattattcaccattatccaccataggggccaatccacaaaacatgtttactctgaaagaagttagaccacacccattctgcccagtggccctccgggaacatataattaggccatgtaatccataagaagcagtgtaggaaaagcttctagtgggaaaagttcacgtgctaaacttttaaggccttactttcttttctatacgttttttagactttaattctgaaaacacattaatagtcagagatcagatggcagtctgaaaaacaggaggctgcagctgggcgggccatgggggctaagattctgttgtatagacttggagcagtttctcctggtgcccctctttcagagttattcatggatgaaggaagaggaaaaggtgagaaagcaggagcacgtgactaaccctgtcatttcagagcatggtttctaggcaactttggggctccctggagtggctgagaactggtctataagtactgttttatacccgttgtcccaacataattaatagtgtcccctttcactctcaagagtatcctggtttgccgggcatgttggttcacgcctgtaatcccagcactttgggaggccgaggcgggaggatccattgagcctgggaattcaagaccagcttgggcaacatagaaaaagaagtttaaaaaaaaaaaaaaaaaaaaaaagagtatcctggttttgatgataaagtatatggtcaccacatccacttgatgatggagttctgggaaacaaggccatacgaactgcttggcggaccaatgatcaacatacaattctcaggtctacttgatgctctgaacaagagtgctacaggactgagaatctgtgcccttctcctcctccagagccactccccaccctgcctcctcacatgcatgcacacaagcgaacacacatacccatatgtgaacacacacccacctacaacccagaggcctttttgctgttgctcgaaattgacaaactccctactgggacaagacctttgcaaaatataccccactgaccgagaccagacaatcccaatttttgcctagctaaatgttattcatcctttacatcaaggctttctttgtaccctgtccttcaatttagcagaaccttctattccctttcatagcactcatgtacttcctgattgtgtaattatttctttcatgtttgagtctttcattaacctgtaagcttcatgagggcacaatatccctagggcctcctagcacacactattcaaatatttgttgcataaacaaatggaaagccaggggcagtggctcacacctgtaatcccagcacttcaggaggccgaggcgggtggatcacttgagcccaggagttcaagatcagcctgggcaacatgctgaaatcctgtctctaaaaaaaatacaaaaattagccaggtgggatgacacatgcctgtggtcccacctactcaggaggctgaggtgggaggatcacttaagccagggaggttgaggctgcagtaagctgtgactgcacaactgcactacagtttgggcaacagagtgagaccctgtctcaaaacaaacaaacaaatggaatggggtagaacttagagatctgatgaatgtaaaaaagcttgggtttctattttcttaacacatccatgaacacgaataacaatttctgttagcaaaattaaaacttaaaaaaaaatcaaaacattgatttctaattagtatgactgccatgtgaaggctgattgccagccaaacctttgaggtatagcagcctactgaaatgtctgggtccctcaccagactaatgaagaacaagaagagagaaaaaaaggcttataagggccagtgagataatcatgtccaacaatcgggtctggcataaaaacaaggtggttctcggcagggcgtggtggctcacgcctgtaatcccagcactttgggaggccaaggtgggtggatcacctgaggtcaggagttcgagaccagcctgaacaacagggagaaaccccgtctctactaaaaatacaaaattagcagggcatggtggcgcatgcctgtaatcccagctgctcgggaggctgaagcaggagaatcgcttgaacccaggaggcggaggttgcagtgagccaagatcacgccattgcactccagcctgggcaacaagagtgaaactccatctcaaaaacaaacaaaaacaaacaaacaaaaaaacaagttagttctctacttaaatacagtttaggtctgaattaacatactgcttgccaaatacttccaatgatattcttatatattctactatctatactcgccagtacctcaatctcaaaaaaataagatgctaaattcacaagcttttttatcttttggacaataagaaaatgagcacacaaaagcattcttctgattcaggaaaacaactttgttgctaggaaaattttcttgtttggttacatatcacttatagtataacaaaacagcacagtccaatatctcattaaaaaaatattgagcccatccaccaccctgtcacaaatcagatctctcttggcagagaactccaggatctcagacaaaacaacattctgacttcaaaaaacagttcgtgatttagcacaagccagaaatcatttttttttgcattttcagacagagaaagttttatctagaatattttgtaactcattttcatacatatctgatttcagtttttattttcttaccacgtccatgaacacaaatgacaatttctttttttttttttttttttttttgagacggagtttccctctgtcacccaggctggagtgcagtggcgcaatctcagctcacgtaacctctgcctcctgggttcaaacgattctcctgcctcagcctcctgagtagctgggattacaggcgcccactactacacccagctaattattgtatttttagtgaagacagggtttcaccatgttggccaggctggtctcaagctcccgaccacaggtgatttgcctgcctcggcctacaaagtgctgggattacaagcatgagccaccgtgcctgggcacaaatgacaatttctgctagcaaaaccaaaactttttaagaaaatcaagacactgatttctaattagtatgcctgccatgtgaaggctgattgccagccagccaaacctttgaggtacagcagcctactgaaatgtctgactccctcaccagttgaattattttcaacaattacttaacttctccaaaatgcagtttcctcacttataaatggggataataatagaacccacctcaaagactcttcctgagcaaagagtttagcgccaagggccaagctcacagcaagtaagtgctcaataaacattatctatcctatatggcaggccactttattttttggatgaagaaaataaaaggtaaggataaatgacctgttaaagaccccaacacaattctagttcacttgatgaggtaggcagaataatggcccctcaaagatgtcttctatttctggaacctgtgactgttacctcacacagcaaagggaaattaaggttgcattggaattaagtttactaatcagttgcccttaaaatagggagatgatcttggattatctgggtgggcttgattcaagcataagagtgcctgcagtctaagagggaggcagaagaagaggtcagaagggggatctgcaaacgacttgctgcaggcttcgacaatagaggaaggaagctggaaacagccctcagccagcaaaacagaccttggtcctacagcctcgaggaactgagttctgtcaacaatctaaatgagcaggaaagaaattcccccctagggcctctagaaaggaacgcaaccctgctgacaccttgatttagaattggacttctgacccacagaactaagataatcatttgcactactttcaacctgtaaatttgcagtcatttattttggcagcaatggaaaactaaaacaatgacataaggattcctgactacagggtatggttccattttctatcagtggacattatcttctcaggcagaagcgaaaatgtgcagtatcacatgagtggtggttgatgactatcatgtggctagagtccagccatttcatatgttcctcacatgagataaccttatttaatcctcaaaacagctccaggaggtactatgccagttcccacagagctggagtaacttcccaaggtttcagggctagtaagaggcagaggtggggtaggagtctggtgctcccgctcctcttagtccactggacaacgctgtatcctgcccactgataccaagagtgcattcctttctaaagaggagatgacattattcaggatttctaacttttcattttggtaaataatggtgtttttaaaaagaaagaaaaaatcatttcaaaatcatttcctaatacctgtagttcttagaattttagacagcaaaaaattacaaagcacaaactcataactttatggaaaacccatcaagctgtcatttaaaaaaaatacagtggtaagaatacttaacatgacatctgccctcttggcagatttttaagtgtacaatacggtactgttatctataggcacagtgttgtgcaaggggtctgtagaacttattctctttgcttgactaaaactttgttgattaccaactccctatctctccctcccccaatccctggcaatcgccattctattctctgcctctatgagtttgactattttaaatacctcatacaagtagaatcatgcagtaattgtccttctgtgattagcttacttcaaagatgaacattttaaaactacatgacttactttcagccaaactttgccatgtttagagagccgaggaacttctaatggaggaagaaaaagcagggcatgtttactcagggtggtggctgctgcttccctttcattttcctgctgagccagcaagggcctgaataaaactattaacagctcagctttagaagttctgctcagttttcacattggtaacaggtttatgcttctttattaatttcctgccttttaaataattagtgttggccttcagcagtcattgtacaattctgtgatagtaatttgttgcattaaaaaaaagctagtgaaaaactaaaatatgatatttactgagacatactgctgtgtttagctaattataagacaactctaagctgggtgcggtggctcacgcctgtaatcccagcactttgggaggccgaggcagggggatcacctgaggccaggagttcgagaccagcctggccaacatggcgaaaccccgtctctactaaaaatacaaaaaaaaaaattagccaggcatagtagtgaatgactgtaatcccagctacttgggaggctgaggcggaagaatcgcttgaacccagaaggcggaggttgtaatgaaccaagatggcaccattacactccagcctgggcgacagagcgagactccatctcaaaaaaaaaaaaaaaaaaaagacaactctagtcgggtgcagtggctcacgcctgtagtcccagcactttgggaggctgaggcgggtggatcacttgaggtcaggagttcaggaccagcctggccaagatggtgaaaccctgtctctactaaaaatacaaaaattagccaggcgtggtggcgcacgcctgtaatcccagctactcaggagcctgaggtaggagaattgcttgaacccaggaggtggaggttgcagtgaacgcgatcgcaccactgcaccactgcactccagcctgggctacagagcaagactccatctcaaaaaaaaaaaaaaaaaaaagacaactctaaaagagccatctgtgaccctgaggactgacacccacaactgacctcctgacacccacaactggccttcatctctgatactgagaccttgggttaggactattctgaaagggtttcggattagcaatggacaatcaataaatatttcatgcttttattaagctcctagagtcaaagagtgaaaaccataatggaaaaggtcaataaatcaactacatgaagaacttcttctgatcatcaagacaccaaaactgaaaagacaagccatattgagaaaagacatctgcaaacatctggccaaaactattaatatctaggaaaaaaataaagaacccttataaatcaataagggacaaatgacccatataaaaagtggccaaaagacatgaacaggcatttcaagaagaagccaataaacctgtgaaaagatgctcaatcagggcaatgtaaatgaaaaccacgatgggaaattctgggaacatcttcacatgctagatagtgaggtaactatcacagactacttgggtcatgtcaagaggactcagagccaacttccactagcaaaatgggacagtttgaactttaataagaccaagaattacaaagcattcaaaactatcaaatatgtttaaatctataaacccgtaatgatttttaatttatttattattttaagaaacagggtcttggccaggcgcagcggctcacacctgtaatcccagcactttgggaggccgaggcgggcggatcacgaggtcaggagatcgagatcatcctggctaacacggtgaaaccccgactctattaaaaatacaaaaaattagctgggcgtggtgacgcgtgcctgtagtcccagctactcgggaggctgaggcaggagaatggtgtgaacccgggaggcagagctagcagtgagccgagatcatgccactgcactccagcctgggcgacagtgcgagactccatctcaaaaaaaagaaaagaaaagaaaagaaacagggtctcgctctgtcacccaggctggagtggagtggtacgaacacagcgctcactgcagcctcaaactcctagactcaagtgatcctcctgtctcagcctcccaaagtgctgggattacaggtgtgagccattgtgcccagcctataattatatatatatatatatacacacacacacacatatatatccatctctatataaatatatatatatatttatttatttatattatttttttgagatggagtttcactcttgttgcccaggctggagtacaacggcgggatcttggctcactgcaacctccgcctcctgggttcaagcgattctcctgcctcagcttcccgagtagctggaactacaggcatgtgccaccacgcccaatttttttgtatttttagtagagacggggtttcaccatgttagctaggatggtctcgatctcctgacctcgtgatccgcccacttcagccccccaaagtgctgagattacaggcatgagccaccgcgtctggccctatttttttgagacaaaatctcactctgtcgcccaggctggagtgcagtgacgcgatcatggctcactgcaacctctaccgcccaggttcaggtgattctccagtctcagcctcctgagtagctgggactacaggcgcgtgccaccacacctggctaattttttatttttagtagagacggggtttcaccctgttggccaggctggtctcgaactcctgacctcaggtgatccacccgcctcggcctgccaaagtgctgggattacaggcgtgagccaccgtgcctggccattatttttaaagaaaaactaacaggtgatcttctgaggaaagggaatgaattcattattttgaaactggataaataagagaaaaaaatcaagtaattatcttgtttttcctatataaactataactgggtaactagtagataagagaaggggttctttatcaaaatatttcagctaatttgagaaaatgaaacaatagaagcaaaatatcaccattttcttttctttttttttttttttgagacagagtcttgttctgtcaaccaggctggagtgaggtggcatgatcttggctcactgcaacctctgccttgcagcttcaagcaattctcctgactgagtctcctgagtagctgggactacaggcacgtgccaccatgcgcggctgattttttttttttttttttttttgagatggagtctcactctgtcgcccaggctggagtgcagtggtaggatctcagctcactgcaagctccgcctcctgggttcacgccattctcctgcctcagcctcctgagtagctgggactacaggcgcctgccaccacgcctggctaatttttttgtatttttagtagagacagggtttcaccgtcttagccaggatggtctcaatctcctgaccatgtgtggctaatttttttgtatttttagtagagctggggtttcaccatgttggccaggcaggtttcgaactcctgatctcaagtgatctaccctcctcggcctcccaaagtgttgggattacaggtgtgagccactgcgcccggccaatatcaccatttctatcccccaaagattcaatgggtctaggcattgagcatctacagctgctaaaaccaataaaaacaaagcaaaaaccagacttatgtgcctacgtggatctagagcattgccaaaaggatcaaacaggatctggttcaagtagcccgtgcatccagctgccaatgtgcagggagtacagagaacacgttaaactatagcataaatgtgtaatcagcaaaacccaaaccgttggaaactctataggtgaaatgtgccagactgttttaacagataaactgtaaggaagtcaactccaaaagatggaaggggagcctgtagattaagagagacttaaaaaaaaaaaaaaaaaaaaaaaaaagttcgggcatggtggctcacacctgtaatctcagcactttgggaggccgaggcaggtggactgcctgaggtcaggagtttgagaccagcttgtccaatatggtgaaaccccatctctactaaaaatacaaaaattaggcgggggcggtggcgtgcgcctgcagtcccagctactcgcgaggctgaggcaggaaaattgcttgaacccagaaggcagaggttgcagtgagccaacatcacgccactgcactccagcctgggcgacagagtaacactccatctcgaaaaaaaaaaaaaaaatcaaaagttgtttaaggcaagtacattattggggcaactagggaaatttgaacatgggctatatattagataacatttgtgtaaataatgaaatgccaactttcctgagtacaataacggtattgtgatcatataaatgaatgtccacgttctttggaaatacatgctgaattagatacagatggaaaatgcaatgatatctacaattaattctcaaatggttcaggaaaataaaatatactcgtgtgtatgaacaccatgcataggtgaaaagatagattatgcaaatgcagcaaatgttagtgaatctaagtgaagggtatattcattgtactagtcctgcacctgatctgtagttttgaaattttctcaaaatgaaaattgggaaataaagtaaagccacatacacatatactccatgatgaaaaactcttttaaagccatcacactggcaaaaatggtaacaattacttggcatcatctagtaaaactgaagatatgcagaccctatgaatcaggaaccctggtctagaaaaattcttcacaaattatgaagccatgctgtgttgtaatagtaatatactgaaacccacccaaggagccaccaacatgggtattttcccataaagaaaatatgaccaggcgcagtggctcatgcctgtaatcccaacactttgggaggctgaggagggcggatcacctgaggtcaggagtttgagaccagcctgaccaacatggtgaaaccctgtctctactaaaaatacaaaaattagccagggatggtggcgcatgcctgtagtcctagctactctggaggctgaggcaggagaattgcttgaacccagcaggcggaagttgcagtgagtcatgactgcaccactacactccagcctgagcaacagagtgagactccgtctattaaaacaacaacaacaacacaaagaaaatagtctacagcagtgaagatgaatacactactgccatacataacccataaacaaaatgttaagggaacaaaacaagttgcaaaataatatgtagtaagactcatctagataaacttatatatatataatatgtatatttagacttaaatttggtatatttttataaaggcaaaaacaggcaggctcaacaatagtatttcagaatacagacatatatggttaaactggaagaaaagtttaaagaaaaacaagggaatgaaataaaattccagataatggttccctctggggagacttgggggtgaggggacccatggaagacttgaaaggcatcggtaatttccttttttttttttgagatggagtcttgttctgtcgcgcaggctggagtgcagtggcgcgatcttggctcactgtaacctccacctcccaggttcaagcaattctctgcctcagcctcccgagtagctgggattacaggcacctgccaccatgcctggctaattttttggtatttttagtagagacgggttttcaccatcttggccaggctggtcttgaactcctgacctcgtcatccacctgcctcggcctcccacagtgctgggattacaggcgtgagccaccgcgccccacggtaatttcctagttttaaaggtagataattggttggtatgtacatggtcattatagtgttggattttaaactatacatatgttatatattcttgtaacttaaaagaaagccctagactgtaccaagatgacaatatttctggacacacctatctttgcttcatagttctgacaaaaagttcattttaactgaagcagataaattcctcttaagtaaccaatgatgacagactgaaacactactttattggtagaagactcagcacaaacatttagaatcatttcgtaagagggaaaagggatgtggcagagcagcaaaatgccacagacctgtttgggatatttcagagtaatatacccccatgggaaataataccgttaagaattgtgccatcattcctaatttaaaaattttcagtgccctgttttatgtatgtatgtatgtatttagagaccgagtctcgctctttcgcccaggctggagtgcagtggcacgatctcagctcactgtaacctccgcctctcaggttcaagtgattcttgtgcctccgcctcccaagtaggtgggattacaggtgtgtgccaccatgcctggctaatttttgtgttttcagtagagacgggggtgcgccatgttgtccaggctggtctcaaacttctgggctcaagtgatccacccgtctccacatcccaaagtgctgggattacaggcgtgagccaccacacctggccagcaccctgttttaaacatagtgtccacagtttctctgactatgtacaaccaaaagccagtacatctgttacatgattagaatacaaacaattggccgggcacggtggctcaagcctgtaatcccagcactttgggaggccgaggcgggcagatcacgaggtcaggagatcaagaccaccctgcacaacatggtgaaaccccatctctactaaaaatactaaaccccgtctctattaaaaattagccaggcgtggtactatgtacctgtaatcccagctactcgtgaggctgaggcaggagaatcgcttgaacccgggaggcggaggttgcagtgagccgagatcgtgccactgcgctccagcctgggccacagagcgagactctgtctcaaaaaaaaaaaaaatatgaattagatgatacttaattgagactggtaattaaagctggacttgaaaaccaacttcctaacaagctaagaaacaaaaaagtccccttcatgaagcgtcccttaattcccttcaatgaagacaagatatcttcatccaaaaatcatacatttttgtgtgtgcctttcttctggcatttatcacattttatcttgtattttggtcatatgctttccttatctcctttactagattttgaattatttgatagtctatgaagagaatatactcagctccaaggccccagaaagattcattttccagggtagcttaaatcttagctctcattaaaaaaacaaaaacaaggccgggcgtggtggctcacgcctgtaatcccagcactttgggaggccgagatgggtggagcacctgagttcaggagttcgaggccagcctgaccaacatggtgaaaacccgtctctactaaaaatacaaaaattagctgggtgttgtggtgtgcgcctgtagtcccagctactcaggaggttgagacaggagaatggcttgaacccgggaggtggaggttgcagtaagccgagatcgtgccactgcactccagcctgggcaacagagcaagattccatctcaaaaataaataaataaaccaaaaaataaaaaacaaaaatccccctgaagcccatgaaatctaaagtggggggggtgaagcaagatcaacaaaaaacaatgccacttcattatatcaagtaattcctgaaatttaagaatattgaattttgaattaatagggccttctgctatttttcctttaaaacttgtaataaatatttaatgcagtcaacattaattttttgtatttttagtagagatgaggtttcaccgtgttagctaggatggtctcgatctcctgacctcgtgatccgcccacctcggcctcccaaaattctaggattacaggcatgagccaccgagcccgaccgttttttttttttgtttgtttgtttgtttgtttttgatacagggtttcactcccattcaccaggctggagtgcagtggggtgaacatggctcaccacaaactctacctcctgggctcatgagattctcctgcctcagcctcccaagtagatgggactacaggtgcatgccaccacacctggttattattttttttttggtagtttttgtagagacagggttttgccatattgcccaagctggtctcgaacacctaggctcaaagcgatttgcctgcctcagcctcccaaagtgctgggatttcaggcatgagccactgtgcctggccctgattttattaccttctattgagaacagacagctgtcaataaaattatccttggagagtaacaaacaggagaaagccttaagttctcaatgactctgaagaaggcaagggtataaagacagagagaaatgcaaaccaatcatgagctaattaaaaatctttaccacctcactctaaaaagatctgcatataaatttgggtagctttaatatctaatgtcttcaaatgaccagaaaatgttggcctgcttaactggtatcctaaccacagtccagctgcttctgcactgggctgaattcttagcacagtcagagaatgctgtttccaagccagaggctcccgcagccctcactttagctttggtgtgcgtgtgtgtctgcacagacaccacagtgagcactccggggagcctgggggactccctctggctttggtgtgcttcagtctgcagtcacaccacaatgaaggctcgcagttgaggcttttagtctcactttccacatttctgtctagggctgtttagagatttcttgatattttacttcctttcccatataaaatttagtgtgcatttgtttttttgcttgtttgtttttgtttttttgagatgaagtctcgctctgttgcccaggctagagtacagtggcgcaatcttggctgactgcaacctctgcctcctgggttcaagcaattctcctgcctcagcctcctgagtagccgggattacagacgtgcatcaccatgcccagctaatttttgtatttttttagtagagacagggtttcatcatgttggccaggctggtctggaactcccgacctcaggtgctccacccgcctcggcctcccaaagtgctgggattacaggcatgagccaccgcacctggccgcatttgttaaggaattttttaaaaaggaaaggaagcttccatagaaaatatcagagaaataaaacaaaaaacaatcaaaaaaacagggattgccaaaagactcttgatattggtatagaatttcctattcaagagctagtttaaataggctcgagaaggactaattcctttagaaaccaccagtataaaaattagtggggttttttttctttttttctttttttttttttttgagacagggcctcactgtgttgctcaagctggagtgcagtggcgcaatcatggctcactctatttagcccttaccttctgggctcaagcaatcctcccacctcagcctcccaaagtatgccaccatgcccagctaaattttttattttttggagagatagggtctcactatgttgcctaggctggtctcaaactcctgagctcaagtgatcctcccaccttggactcccaatgtgctgggcgtgagtcactgcacctggccaaaaaatgagtcttaagatttcactagaagattatttatgtaaataataaagagggcttataatttattctgttacttccaaatcccagttcaaaattctggattttaattctgagatagttatttatatgtatttttttaacttgtcaatgatttgaagctcagttatttatttttttttaaaaagtattttcattgaaaaatgaacttccttcaatctgtgatgtagaaggtatattaatataagaagtctaattcttccttagctggctgtgcctctgagtgcttagtagagacatgataccttattctctactcattcttccttatcagtgggaggaagggaatgttccaagcgaacataggcaacatttaatcggctatgtggccactaaaagagatgaaaggtgacaagttcttacaattacacaacttcttccctctgttgctcatgtactagacagcacagagaacgtggcctttagctggtagctagtccccaacatacgatggctcacaccctcagctgagctgagaagcctgggggataaacagaaacagcagtgctaaggaaagaacagaactcatgataagtgaaaaaccaagaggaagaggctctcaattatgtctttttcctgggagcatagtacattccctttgaattcagtttcaataagacttttaaataatacgctacacttagaggaaactaggaatacaatataatggaaaatatggtctaagactacggtggaatgcattgcattttatggtcaccacttatttggccctgctgataataaccaaatactcagaagttctactgctctaccaagaaaggtcacctgaaaaatctgagctggagacagaactagaagcaaacagaaaaagcaataaatcaacagggttatcaaatattttacaaaaccctagagaaaccacatatttaaaccaaaaggaagataatgaaaaagatgctcctcaccttttgaaagttctccttccacaaatcttctatgactatatatcctcgtaaaccccagtcatataatctctccccactgaccttaaaacaaaatagaaaagatcttaccatctgacccagcaatccctattattgggaataataatggaatataaatcattttactataaagatatatgcatgcatatgttcatcatagcactatgcataatagcaaaacatggaatcaacctaaatgcccatcaatggtagattttttttttttttttgagatggagttttcgctcttgttgcccaggctggagtggaatggcgcaatcttggctcactgcaacctctgcctcctgggttcaagcaattttcttgcctcagcctcccaagtagttgggattacaggcatgtgccaccacacccagctaattttttgtatttagtagagacagggtttcaccacattggtcaggctggtctcgaactcctggcctcaggtgatccacctacctcggccttccaaagtgctgggattacaggcgtgggccaacatgcccagccaatggtagacttgataaagaaaatgtggtacttatacaccacagaatactatgcagccaaaaagaatgagctcatgtcctttgcagggacagggatggagctgggggccattatcttaagtgaactaacataggaacagaaaaccaaataccacatgttcttacttgtaattgggaactaaaccttgacaacacatggacacaaagaagggaacagagaccgaggcctacttgagggtggagggtgagaagagggcgaggatcaaaaaactacccatcaggtactaggcttattacccgggtaacaaaataatctgtacaccaaaccctcatgacacacgatttacaataacaaacctgcacatgtacacctaacgctaaaagttaaaaaagaaagaaatttaaaaaaaaaaaaaaaagactcctactctggggacagccacatatgcttctcaacgagcaaccaagttcaccctctccactctagctatttactgcttaaaccataacaggctgaaataatgtttaattatttttatatctagggctggaagatgttactcactgttcctgacctggggctggagcagggacagaagcattaactatctgcctccaggactgttacaaacaatgttgagcaaatgctggaaagtactggtatttgtcatcaaagccatcaagctccccaagctggggccactggactctcacatacaactgtagcccaatcaaggaatctggattcaatactgtcatgaacaaccaaggaagctcagtctcaggtcagtctggctcagagtccaatttgggtgactgcactgctgtctgctcctggaactgagtttccatgtgatgtggtagttccagcagctaaagtccctgtgtccacaatctgcccaggacctcaaaacctagagcctgtcttgttcttaccagttcctgagggacaccatctctagagtcccactcactccagatatcacccttttcaggctacctactggtctccatcagtggttctcaaacaccataggcattaataacaaaccaccggagggcttgctaaaacacagactgctggcccttactcccagagcttctgattcagtcagtctggggtggggcctgagagtttgcatttctaacaagttctcaggtgatgctgctgcttctggtctggtaacacattttaagaatcggtggtacagctttatccatgttgcctgccaccgtgatagacctgcttgccagggtaccataagactgaggcttcaaggataagaaaggagcagccaactgaaagccccgaaaagggcactccaagcagaggggattacagtccccaaagtccccagcaaggaaagcaagggcaccagtactagggaggagtggaagtcagagtagtctgggtctacaataccaacgagagcaggttgtgaccggacatgcataaactgagtgacccataattatcagctttggaatttgagtctctagacttccatgtaagtatacaaaaaatgtatattaaatttttgctgatgaacattcaaacaatcacgcaaattcgtgttcaaattctgtgaacactggcattactggaagaagggccagaactgaggcatatagtggagaaaatcatttaaattttctgtattcatctatatgtacaaacaaattttagtctggtgttataagaactgcaaaataaaataaaattaagcatcagattcatacacacacaaacaagaatgagggacatcatggattacagagtttctcttacctgggcaaacacgatggcttgttgtggataatagagggaggcagctaatcccatgaaaccaggcggatacactagcttctttatttttgaacctgataaataaaaggttgtacacgccatcagatgattcattatcctcaccatcacaatttaccttatccatttaatacggaacaaggccaggcacagtggctcacgcctataatccaaaagctctgggaggccgaggcgggaggatcacttgaggccaggagtttgacaccagcctgggcaacatagtcagatcctgtctctacaaagattaaaataaaaaaattagccaggcgtggtagtgtgtgcctatagtcctagctacttgggaggctgaggtgggaggattccttgatcccaggagttcgaggttacaatgagctatgatcacacctctaaactccagcctgggtgacagagcaagaccgtgtctcttaagaaacccaaacaacaaaaccaaaataaccccaccactgaataagatttctttggtcctaaactgaaagaatgtgccaaataaagtcatgtgcaccaaaacgcttttgcactgctttattgagataaaattcatattcacccatttaaagtacagttcaatggcttttagtatattgacagaggtgtgtaaccatcattacaattaactttagagctttttcataatcactaaaagaaacccattagcagtcattcctcaactcccccgtaccgtccagccctaggcaaccattgatctactttctatctctatgtgtttgcctactctggatatttcttttttttttttttgagacagagttttgctcttgtcacccaggctggagtgcaatggcgcaatcttggctcactgcaacctctgcctctcgggttcaggcaattctcttgcctcagcctctcgagtagctggggttacaggcacacgccaccatgcccggctaattttgtatttttagtaggcatggggtttcgccatgctggccaggctggtctcgaactcctgacctcaggtgatccacccgccacggcctcccaaagtgctgggattacaggtgtaagccgctgcgcccggccctctgggtatttcatataaatggaatcatgcagtaaatatacggtcctttgtgactggcttctttcactcagcaccaagtgttttcaaaagaacacctttttttccctaagagagcagaaaaaaagattattttaaaaataaacaaatgagtattttggtttctagggtttatgttcttttatagcaatctggcttcctatataaatactaaacacaagcgttcttcttctcccctttctgcaaccccgttaaaaaaacagtaagaaaaaacattaataaacccacaatgaagagaaaatgtgtggaagggccactggcagaaaggaagtgtcaatcaattttcagaaaatggagagtgaacggaaataagaggacacactgccttgaaatcttgaaatcttgaggaggagtgcagcctcagagggagcagatctgtcccaggcagccccagggagattccagatccagagatggcaggtaccatggggagtggagatggcaaccagggagcaagacaagggcacaggacaaacgcaagtccgatgcatggaccagcatggcctttccttcccctatgccatcccagtacaaaactacccctggccaggaagtcacaccagttcaaaatgttaaaaaacccagtaaaccagggttactgggtgtggtggctcacacctgtaatcctagcacttggggaggtcgaggcataaggattgcttgaggccaggaattgagaccagctggagtaacatagcgagactccatctccatttcttttttttctgttgagagagggcctcactcggtctcccaggctggagtgcagtggcacaatcatggctcactgcagcctcgacctcccaggttcaaactatcttcctgcctcagcccctcaagtaggtgggacaagaggtgcaagccatcatgcctggctaattttttttttttctgtagtttttgtagacacggggtttcctcatgttgcccaggttggtcttgaactcctgagctcaagcaatccacctgcctcagcctcccaaagtgctgggatcacaggcatgagccagtacgcccagccccccatctctattcctttaaaaaaaaaaaaaaaatgagcctgatgcagtggctcacacctgtaatcccagcactttgggaggctgaggtgggaggactgattgagcccaggagtttgagaccagcctgggcaacttagggagaccacatctctacaaaaaattaaaaaattagtaaggtgtggtggcatgtgcctgtggtcctagctactcaggaggctgaggctggaggattgcttgagcccaggagttcaaggctactgtgagctgtgtctatgccactgcactccagcctgggtgataatttggatgttgttctctctgaatctcatgttaaattgtaatccccaatgttggaggtggggcctggtgggacgtgacctgatcatgaaggtggatttctcacagatggtttaacaccattcccttggtgctgtccttgtgcaacagtgagttctcttgagatctggttgtttaaaaatgtgtgacacctcccccacctctttctcttgctcgcactcttgccatgtgagacaccagctccccctttgccttccaccatgattgcaagcagcccaaggcctcaccagaagccgaggagatgctggtgccatgcttcctgtacagcctgcagaactgtgagccaactaaacctcttttctttataaattacccagtgttaggttatagcaatgcaagaatggcctaacacattgggtgataaagcaagatcctgtctcaaaaaaaaaaaaaaaaaaaaaagagttaaaacagtgggggcagggtatcactaaagaaacaccatggatttcctgctgagaaccaagagagctggaaggggtgagtatgtcagtgcctgagagaaaagccctcctcacactggccctgggtgcacccttgtatatggtcacttcctgcccagctcccctgaggtagaacctgcccgtcagtgggccccatgtacagacagggagttcttttttttttttttttttttttcccgagacggagtcttgctctgttgctcaggttggagtgcagtggcgtgatctcagctcactgcaacctctgcctcctgggttcaagtgattctctagcctcagcctcctgagtagctaggattacagacaccctccaccacacccggctattttttgtatttttagtagagatggggttttcccatgttggccaggctggtcttgaactcctgacctcaggtgatccgcctgcctcagcctcccaaagtgctgggattacaggtgaaagagttcttattagcatttcagctgcctcactttgaaacatgactggataaccaagaatcaccagtcatttgtggaaagcctgaaacataaaggagaaagaccaagacaagcacaaaggaaacagaagaacttcaaaacaaaactaaacctattactaagtatcatcaaataaattttaaaagccactacattaaaagaaaaaaataattctatgaaaaaaagaacattcaaagaacaggaaggagctcttggaaatgaccaaagcaaaaaaaattcaaaaggaacaaaataaaataatcaagaaaatataagagacacatagggtccttttaaataactcaattgctaattaatgcgttgaggaaggaaaaagaatgagagtaaattttcaaagatacacaagataggctgggcgcagtggctcatgcctataatcctagcgctttgggaggctgaagaaggaagactgcttgagctcgggagtttgagaccagcctgggcaacatggtgacacccggtctccacaaaaaaaaaaattagtcaggtgtggtggtgcatgcctatagtcgcagctactcaggaggctgagatgggaggattgcttgagcctgaggaggtcaagactgcagtgagccctgatcatgccactgcactacaacctgggtgacagagtgagatcatctctcagaaagaaaagagaagagaagagaagagaaagggacgggacgagaagggaaggaagaaggagggaagggaagggagaaggagggaggggagggagggatgcaggggatggaaggggagggaggagggaaggggagggagaaggagggaaggggagagagggaggggagggcagggaagggagaaggagggagggagggaggaaaagaagatattttccttcagctggatgctgcaagccgccatattgtttgggcaagaatgaaaacactatatccaaggctgggcatggtggctcatgcctgtaatcccagcactttgggaggctgaggcgggtggatcactggaggtcaggagttcaagaccagcctggccaacatggtgaaaccccatctctactaaaaccacaaaaattagccaggcgtggtggtgcacgcctgtaatcccagctaactgggaggttgaggcgtgagaatcacttgaacccagaggtggaggaggttgcagtgagcggagattgtgacactgcactccagcctgggtgacagagtgagactccgtctcaaaaaaaaagaaaagacttctatctagtcacagcaccaaagaaattcagaacactaaagattcacagaagatcttcaaagcttccaggaagaaaaaaaaaatgtatcacctgttcagaagcagcaaatatccagaatggctactgactctcacatctacaacgccagatgctagaatacatggctttgaaagttttgatggcaaacaaaattcagtgcccaaccaaactgtcacatggtatgagggcagaaagtgattttcagacatggaaggtcttgggaagtttacctccaacatacgcttttttgaaagtgacttaagcatgtagttcaacagcacggcagagtaaaccaaggagaagatgacatggaacccaggaaaagggggcttaaacccaagaaagtgtgaagaagaccagtcccaaaacaagaactgtgttgaagtctcaggccagattgtaggaggatatagagctgtggagcaagggaaatggacagaagagacagcaggacacagagcctggagaaacctgagaatgaggttaaaaaaaccagtagaggatgaaactagagaatacacatggccttgactccactgagaggcatagtgttttttgctgtgggacccatatagatgctagcagaatgtgtgtgttattgatttttttttttttttttgagatggagttttgctcttgctgcccaggctggagtgcaatggtgcaatctcggctcactgcaatctccacctcttgggttcaagtgattctcctgcctcagcctcccaagaatctgggattacaggtatgcgccaccatgcccaaataattttgtatttttagtagagacagggtttcactatgttggtcagtctggtctcgaactcctgacctcaggtgatccacccacctcagcctcccaaagtgctgggattacaggtgttagccaccatacccggctgatttgtttgtttgtttgtttgttttgagatggggtctcgctctgttgctcaggctggagtgcagtggtgcgatctcggcttgctgcaacctctgcctcccgggttcaagtgattctcctgctttcgcctcccaagtagctgggattacaggcacccgccaccacgcctggctaatgtttgtatttttagtagagacgggtttcaccatgttggctaggctagtcttgaactcctgacctcaggtgatacatccgccttgaacttctgaagtgctgggattacaggtgtgagccactgtaccccgacagaatgtgtacattaatccttaaacggttctaatcacataagtactgtttattggctttaaaactttaaacagagaaatccccaacgatggaactgggactgctgaagagaatacaaatgttatcaacctagactattaatgatttactgtttctctcctgatcctgttgcatgaattgaaagggtataattatcctagaagagaaaagcctgtgatatccctgcatatggcccctcccctgcccccatccacttgaagcagctcacccaagtgaggaccagggaaagagcagccaacctgccacccagtcatttctcactcctccagggagagccgagaagtggcagctctcgggcctccagctcctgctggttcacacaatgagccagagacccaagaacttcaggaaggaggtgtaatcatactcccctgcccccacctccatgccctatctcccaagaggccagtggtacaggttgtcactatcagcactgccaggggcggggggaaccactggtggccaatgctggggagagccaccagaaggcaacaatagtgtcaacaaccacgtgtcatcttggagtggtctggctgggcccacttcctctgaatggacatccattcacctctctgagagcctcttgtcaccaccacagttgtggcaatcctcaacaactgaagcagactaccttagcagatacgctcaagaaaccccaccaggccaggcacagtggctcacaactatgatcccagcactttgggaggctgaggtgggaggatcacttgaggtcaggagttcgagacaagcctggtcaacatggtgaaacctcgtgtctactaaaaatacaaaaatgagctgggcatggtggtgcacgcctgtagtcccagctactcgggaggctgaggcaggagaatcacccgaacccaggaggcagggttgcagtgaggctgagatggcgccactgcactccagtctcggcaacagagcaagactgtctcaaaaaaaaaaaaaagaaactcctatcaggagggaccttctgcacccacccaccctgctgctgccctcaaaggggcccattcacctggaggggcctgcaaaccattctggctacccacagacatccctatcaccccactcatcttgcttggtgaacccctctgatgctgctcacctcaggtctttctatacccaacgctcaggagaaaagacctgctattgcacatgtgtgtgtgcgtgcctgtgtgaatatttgtgaaaaagaattaaggtgtcaaattattttaatactaccaagctctccccaggaaaaggaagaaaagagacagaacgaacaaacaaaatcagaggactaggacccactgtagcagatgtcctcatgctgctgctctggccaggagagcaccatctccaatcctccttaggatggtcatcctagtggatgttccagggacaagctctcggcactgtaggaacgtacccacagcacagaaaaagtgctttctttggacctggaagattttcccacatgctctaaccaggagagggagggggaagctcctctcactcacttctacattcctatctccctaacgatagctgaaatcccaacaccctggccttgggatgttcatcaatctcaaacgctatctaaataagaccgaatgctcttctgaacagctttgcaagaaatgaggtgaaagaagtttagggaaaaatgttggttcataagttgattacaaaaataagctggaaatttaattctgacatattctgcatgagatgggaggagggcacaaagactgtgacatgagttgcttccacaggtgagctggtagtgccaccagggcagtgtctaccctccagattcaaaaataacagccattagctgggtgcggcagctcatgcctataatcccagcactttgggggacaccaagggaggtggatggcttgagttcaggagttcaagagttcaagagttcaggagttcagcctgagcaacatagcgaaactccgtctctactaaaaatacaaaaattacctgggcatggtggcaggcgcctgtaatcccagctacttgaaaggctaaggtgagaggatcacttgagcccaggaggtccaggctgcaatgagctatgatcacaccacttcactccagcctgggtgacagagtgagaccctgtctcaaaaaagaaatcaattaaaaaaaaaataaggccaggtgtagtggctcacacctgtaatcccagcactttgggacaccgaggcaggccgatcacttgaggtcaggagctggagaccagcctggctaacatggcgaaaccccatctctactaaaaatacaaaaattagttgggcgtggtggtgcacatctataatcccagctatttgggaggctgaggcaggagaatcacttgaacccaggaggcggagggtgcagtgagccgagattgtgccactgcactccagcctgggcgacagagtgagactctatctcaaattaagctaaacgaaacgaaacgaaacgaaacgaaacgaaacgaaactaaactaaactaaagtaaaagctattgcatgtagagggaagattttttaaattggaggaataggactgatacagtttgaatgattgtcccctttaaatctcatgttgaaatgtgaacccccacgctgggaggtgtttgggtcatgggggtggatccctcatgaatggcttggtgccctccctgtgggaatgagtgatttctcactctattagttaacatgagggctggttgtttaaaagagcctggcatctctctagctccctctctcaccatgtgatgcgcctgctccccctttgccttccaccacgattggaagctttctgaaaccctcaacagaaatagatgctgatgccacgcttcttgtacagcttgcagaaccataagccaaataaacctcttttttttttcttttgagacggagtctcgcactgtcgcccaggctgaagtgcagtggctcgaactcagctcactgcaagccccgtctcccaggttcacaccgttctcctgcctcagcctcccgagtagctgggactacagacacctgccaccacacccggctaattttttgcatttttagtagagacggggtttcaccgtgttagccaggatggtctcgatctcctgaccttgtgatccacctgcctcggcctcccaaagtgctgggattacaggcgtgagccactgcgcctggcatctcttttctttataattacccagcctcagatattcctttatagcaatgcaaaacaaactaatacagggaccagagtagtctctatggttctcttttacaggggtctgattacaggattcataaactttcttcattaggaatgatggtaatgtcagaattttatatcataaacatttagtttccaactagcaaaacttcaagtagttgataacaaattcatctcatcatagcaaagtattttattagcctttatttcctatagatattttataatctagcagtatagtaatatttttaagttggcatttgttagtatttaaagcatttttaaagtttttgtcatcactgactgaaggcatgacaaatcaagaaggtaataaaatctctattaaatcactgctctatctactgtgattaatatagcttgatcttaatagtgaaacgtttagaaacagttgatttctcaggtgtgaaagactttaaaattttgctctttctgtaccaaagaacaacagagatttgatcaagtaaatgtgcctataaaggataacttcttttttttaccaagagtatacaatttctatttatgtttaaaatcaaatatgataaccatatccattatacattaagaaagccgtatttaggaaccaactcattattctgaaacctggtaaatgaagggaaagaatgaaacatatattctatctctgctttatgagctgactgttaaagccataaaattgcacctacctctagccaaaaggagtccaataaggccagcaaaaccaataacaccaagtctcggaaaaaatccaggaggtgcattttggagatagtcatagctgtctacaatagaattagaccaggaagcagttccataaatttctcattaaaaaacaaaacaaaagtcttatacagtatataatatgtatatatagtatcaagtgcttttcaaaccacatattctctgcatcctgctactatacttctcttcaacatactctttttatgtgacatataaacaagatttactattcacatagcaagtgtccaattttcttttctttctttttttttttttttgagatgaagttttgctcttgtcgcccaggctggtgtgcaatggcgtgatctcggctcactgcaacctctgcctcccaggttcaagcaattctcctgcctcagcctcccaagtagctgggattacaagcgcccgccaccacgcccagctaacttttgtatttttagtagagatggggtttcaccatgttggccaggctggtctcgaactcctgacctcaggtgatctacccgccttagcctcccaaagtgctgggattacaggtgtgagccactgcgcccggctgcaagtgtccaattttcaagtacctttggtccaacaacctactgacaatgaagtaaatgttaaattactttcatattcctgaaagcaacagatctgaatcagcaatttgcacagggaggaatacaaatacagggatcctttgctattcaaactcttgttatggaaacacaaaaacagaatagatttggataaatctttggatagatctattgctatctgaagctttgctgcttgctctctgaaactcaggaaccaaaaacaagctgtgagtggtggctcattcctataaactcagcactttccaaggctaaggcagaagaatcatttgagcccaggagttcaaggctgcggtgagctaggattgagccactgcactccagcctgacagcctgacagcctgagccacagagcaagacacagcctcttaaaaagaaaaaaaaaaaaaaaaaaaaaaaaaggaaggccaggtgcggtggctcactcctgtaatcccagcactttgggaggccgaggagggcggatcacgaggtcaggagttcgagaccagcctgaccaacatggtaaaaccccatctctactaaaaatacaaaaaaattagctgggcgtggtggcacgctcctgtaatcccagctactcaggaggctgaggcaggagaatcatttgaacccgagaggtggaggttgcagtgagccaagatcgcgccactgcactccagcatgggtgacagagcgagactccttctcaaaaaaaaaaaaaagaaagaaatcaaatacattagactcagaaaaataagcatcctttgccatctgaactcattactcgaacagaagaacagaataaatttggataataaaggaaacttgtaatttcactcagaaaatagccactgttgatcgctgttgatggtgatagaataaaaataaatacaacatgtgacctattcatcatgactgaacatgccttctgacttcattcacataatgcctcgtctcctctccactgagccaatcccacctcataaaagccaagttgagtcctacttccacacaaaagcctttcctaagctcatcagttcacacctctctccctcctctaaagtcccatcatatttattctctgtaccatcacttggtacctaatcctatagtaccctgtgtttaattattcaggtgtatatctggtgtctccccaaggagaatgtaagctccttaatgatagattgcttacacttctgtgttatcttccctcagtggtaataatggatgttcattcaatagatatttattaagaatgatggctgggtgtagtggttcacgcctgtaatcccagcactttgggaggccaaggtgggaggattgcttgagtccaggagttcaagaacagcctgggcaacatggcgaaaccctgtctctacaaaaaattaaaaaaaaaaattagccaggtgtggtgatgcatgtctgtggtcccagctacttgggaggctgaggtgggaggattgcttgagtccaggaagtcaagactgcaatgagctatgatcatgccactacactccagcctaggtgactgaatgagaccctgtctccaaacaaaaacaaaaacaggccaggcgcagtggttcacgcctgtaatcccagcactttgggaggccgatgcaggcagatcacaaggtcaggaattcgagaccagcttgaccaacatggtgaaaccccgtctctactaaaaatacaaaaattagccaggcgtggtggcgtgtgcctgtaatcccagctactcaggaggctgaggcaggagaatcgcttgaacctgggaggcagaggttgcagtgagccgagatcacaccattgcactccagcctgggcaacagagcgagactctgtctcaaaaaacaaaaaaacaaaaaaacaaaaatcacactgccaggagttgataaatactggatgtattccatcctggctaacatggtgaaaccccaactctactaaaaataccaaaaaaaaaaaaaaaattagccaggtgtggtggcaggcgcctgtagtcccagctactcgggaggctgaggcaggagaatggcgtaaacccaggaggcggagcttgtagtgagccgagaccgcgccactgcactccagcctgtgcgacagagcaagactccgtctcaaaaaaaaaaaaaaaaaaatactggatgaattaacaaatgaattttagctaggtcatgacttacacaaagccctcatgtctccttctcaatctcatcttcagcactccctatctacttagggttcctcaaacatccaataccaagtcacacctctaagcctgatcatgctgggcccagtgtgcaatgcctgcttccagcagtcccacccccacattttggagtggctaacactgctccttcaagattcacttcagaagtccttccctgactgctcccacctcctcgatttcaattaaactaatctccttcctctgtaccttcaataatggtctgtgattatctctgtatttgcactagtactgaataatatattacacgcatctcagtggttgtgaccactgtcttaaccaatctcaattttcgaggcctggcagaatggtgacttaaaaaatatatacagaactgaactaataaactggaaaactcagcaattctgtcccctaagtaataccagatacacgccagttttccttttcctgggttctttgggaaatgtgatcattttaaatactactataggacttgtattatgtttgcattaattactgtctggcctgttacttattttgcctttagcctagtttttactttccatcctctagtctgggtcatttgaggcaattttttacttccctttatttttgcctactagcccagtgttgctcaattctagatgtgtacacagagcagttgacagagggacacccagatggctctggtgagctgggccaaagtgggtaaatcacaaagaaaggggaaagaagatatgttttaagactgtacggagtctgggcaaaaaagtgagaccctgcctctacaaaaagtggaaaaaatgtgatggcacatgcctgtaatcctagctactcgggaggctgagctggaaggattgcttgagcccaggaggttgaggctgcagtgagctatgatcacgccactggattccagcctggatgacagagaaagatcctgtctcagaaaaatttaaacaagagacctctcagccacacatggacagataaaagactatatcaggagttctctagtttcctcggataaaaatgaagataataaggtatctgtcagcttgttatgagaatttatatatatatatatatatatataaaatttttgtgggtacatagtaggtgtatatatttacggggtaaatgaggtattttggttcaggcatacaatgcataataatcacatcagggtaaatgaagtatcctttacctcaagcatttatcatttttctttgtgttacaagcatcccaattatactctttcagtttatttacaatacctaaaagagtatagcttttttagttatttaaaatgtacaataagctaggcgcggtggctcacacctgtaatcccagcactttggggggctgaggtgggtggatcgcctgaggtcaggagttctacaccagcctgaccaatatggtgaaacccgtctctactaaaaatacaaaaaataggctgggtgtggtggcgtgtgcctgcagtcctagctactcgggaggctgagacaggagaattgcttgaacctgggaggcagaggttgcagtgagccaagatagcaccactgcactccagcctgggcaacagagtgagaatctgtctcaaaaaaataaaaaataaataaaataataaaaaataaaatgtataataaagtattattgactgcagtcaccctactgtgctatcaaatactaggtcttattcattctaactatatttttgtactcattaaccatcctcactccacccccaataaattggtatttgtaaagcacttagaatagtacctgacatataagtcttaaataagtgtttatgaaattaataaaattaagatgttacttattaacatgccttaataatttaaagaaccagtagggggccaggtacggtggctcacgcctgtaatcccaatattttgggccgaggcgggcagatcacttgaggtcaggagtttgagaccagcccggctaacaaggtgaaaccctgtctctactaaaaatacaaaaactaggtggatgtggtggcacacgcttgtaatcctagctactcgggaagctaaggtgggagaatcgcttgaacctgagagacaaaggtatcagtgagctgagactatgccactgcactctagcctgggtgacagagtgatattttgtctcaaaaaaaaaaaaacaaaaaaccagtaggcagctattgttatgtttgtcttcaaacgataaatttatctgacagtctcagaaatatcaggacatcaatacaccatggtgatcttaccaaagaaactgtacttatgtttattttgttctatcatggaaacaaacccttgtaaaaacaagattttgtttgcgagatgcctaataaggggaatgaaatatgatcggtatctttattaatttaccagtttctgattaagattagtcagaacatggactgtgaatccagtttgtgagtgtatgtgataagtggcccacaactgaaaaataatcaaggaaaataaaaccaaatgaaaaaaaagtaagaacactatcaattatgcagtaagaccttttataggagtaccaactcagctccttcctgcttcaaaacttctagagcatctattaattgcaatgcaaatgagctattccgattcagaaaatctattgatgaattagtatggtgtattacgctgcacctagaaatgagatttcttttttttaaagcagtgtatctgtacttgctagcccaagaatcctaacgatcttgaagagacttacctgactatttggggacactagttgcctgaaatctgatgaaaacaacagctcctcttcccagaaaaatccacatagctctaaaattctgcatataattttaaggaatacacagatttcttggagctcattcatggaactccgattaaagagttcaatgttaatgaagtagctgattatgcctaatttaaaatcaacttacctaacccccattgaaccaaactttgcatcttgggcttagtttgggagtacgtttcctaaaaaggtaaaaagaaactgaatgaaactattcacaggatctgctgattagaaagttaacagaataaatatacttgtttttactgaataaattatcatgttattaacgctttttgaacaaagggatacactgtctgtctgggtctttttgtttgtttttcctattataatcttcccttcactgcaaattactcagcagaatggcttactactgccacaggaagcagattccaaacagagtggtttcaacaatccagccatttcactcttccattaaaatggaaaaaatagactaaaaatcaatccccttgatatttaagtggcaagcttttctccatgagattaaacctgtctttcatattaactacttcctgatctgccattaattagagcctacatctggaaactgcccatttgaagcaagaatgaccagctttaatgagacaaaggctatagcccaaagcaaatgaggtgtcaacattctcttaaaaacaataaaaaggctttgtggccaggcatgatggctcactcctgtaatcccagcactttgggaggccgagtggggcagatcacctgaggtcaggagttggagaccagcctgaccaacatggtgaaaccctgtctctactaaaaatacaaaaattagccgggcgtggtggcacgcgcctgtagtcccagctactcgggaggctgaggcaggagaatcacttcaatccaggaggcggaggttgcagtgagccgagatggcgccactgcactccagcctgggcgtgtctcaaaaaaaaaaaaggctttgtacatgaatatcacatgatcctaaaggaaacgagggacccgctagaaggtacccaccttcaagaagtctacagtgaagacaagaagagatacatgggtatcagaaggtatcaaaactagttgccatttgggaaaggattttttttttatttttatttttattaattaatttttttttttttgagatagagtttcgcttttgtcgcccaggctggagtgcagtggcgcgacctcggctcactgcaacctccgcctcctggattcaagtgattactcctgcctcagcctcccgagtagctgggattacaggtgcccgccaccacgcccaactaatttttgtatttttggtagggacagggtttcgctatgttggccaggctggtctcaaactcctgacctcaggtgatccacctgccttggcctcccaaactgctgggattacaggcgtgagctactgcgcccggcctggaaaaggatttgttttgtgtaattcagttcaagtcagaacaagctatcctcattcttttaaatgacctgaaataataaatgccgaattagccagaagatctaaagaactgagtatcgcttcattaaaatccattatttcacgcctgtaatcccaacactttgggaggctaagacaggagtatctcgtgaggtcaggaatttgagaaccagcttgggcaacacagcagagaccccatctctacaaaaaaataaaaatattaggctgggcacggtggctcacggctgtaatcccagcactttgggaggccaaggcaggtggatcacgaagtcaggagatcgagaccatcctggctaacacagtgaaacctggtctctactagaaatacaaaaaaattagccgggcgtggtggcaggcacctgtagtctcagctactcgggaggctgaggcaggagaatggcgtgaacccagaggcggtgcttgcggtgagccgagatcgcgccactgcactccagcctgggggacagagcgagactccgtctcaaaaaaataaaaaaaataaaaataaaaataaaaatattagttgggcatggtggtatgtgtatgatgtccgagctacttgggaggctgaggtgggcagatctcttgagcccaggagttcgagatcagcccgggcaacatggtgaaaccttgtctctaccaaaaaaaaaaaaaaaaaagaaaaaacttcagatcaatatctagaatgattgccgacttcttttgctagcttaatatttttactattaaaaaaaattaaggccgggcacagtgggtcatgcctgtaatcccagcaccttgggaggccgaggtggacggatcacaaggtcaagagatcaagaccatcctggccaacatggtgaaaccccgtctctactaaaaatacaaaaattatctgggcttggtagcacacgcctgtagtcccagccactcaggaagctgaggcaggagaatcacctgaacccgggaggcggaggttgcagtgagctgagactgcaccactgcactccagcctggcaacagagcgagactccgtctcaaaaaaagaaaaacaaagaacaaaaaaacaaaattaaattggttcttcaagaaaagggctagaaattgctggtctgaaaaaggaaccaggaattagaaatatttctactcataaaggctttgttctacccaggaaaacaaaaccattataattacaaaaactattataattacaagcaagtttttatatttagtagtagtggaaataaacatatagataactaatccatcatccagagaggtattttgctgcactgagtatcacgcatggaagaaaaggtaaaaaacaaaaagcaaccttaggctaaaaggtacaaagtacttttattgccaaaaaaaccaaacaaacaaacaaaaaaaacagacagactacaagtaacagtagtcatgcctacatgatacaaaaatatacacacaaatttgctgactttatcttaactaccagaagtttaaaaatcttctagaacaagagaataaagtctaatcattttacaacatgttatgtttaaagtctttaggtattacttaactcaataatatggttatgatacttaagtataatggcctaattcttattgttgatagagtccatgctttactattttctttctaaattggtgaacaaaagttcaacagcagcataggcaacggaaattaaaaatttttaaacaagctctggatcaaaattgaatttaggccaggcatggtggctcacgcctgtaatcccagcactttgggaggccaaggtggacagatcacttgaggtcaggagttcgacatcagcctggccaacatggcgaaactctgcctctacgataaatacaaaaatgagccaggcatggtagctcgtgcctgtaatcccagctacttgggaggctgaggcgggagaactgcttgaacccgggaggtggaggttgcagtgagctgagagcacgctactgcactccagcctgggcgacagagcaagactccctctcaaaaaaaaaaaaaaacaaaaagactaaatttataaatctcaagcaaggtaaatctagacaatttcccacatatctacatctattagtttttattaatttcaattttcaaaatcaagatcaagtacaacaaacatatgtatcaaagcctacaaaagcattctatagattgtaaacgttggttactgatgttaaaaatcacagaaatacttttcatttacgtaatgacaaatgcctgacctaaaacccaggcagggacagaaaccaatctgtatatgtagttctttggtcactagaacaaatagttcagtaatccagtatggaattctaccctattttagtatagcattcaaaatgccatatcccctcctggtttaagtggcactgatttgtatagtggggggagaaaaacttcgcaatttttatgtaagtgtttacgttgcatctttttcctttgtttagagttccagcccacaagcctcccctggtagacaacaatgttttcataactgcaagcaacaaggtagttcctagcccctctgctctctagttaaggcgttacgcactgcccagggagagggaaattctctctgtagctgtggcaacagctgtcaccaggaagctagggcatctctgcaacccctcctcagatggcactgaagaacatctgtaagtcaggcacttttaacttggggccttgtatttcaacattttttgtgggtacgtagtaggtatatacatttatggggcacatgagatgtgttgacacaggcatgcaatgtgaaataagcacaatatggagaatgcggaatctatccgctcaagcatttatccttagtgttaaaaacaatccaattacactctttaagttattttaaaatgtacaattaaattattgttgactacagtcatcctgttgtgctatcaaataggttttattcattcttgctacttgctattttttttttttgcacccattagccatccccacctttcccccagacccccactacccttcccagcctctgtcaaccatctcagggccctttatcatgcctttttccaaaaacatgcagccaatacagactttcctctatggactctaaacagaaatgcgttcactccattttcagaacagttgtacctgacaccaggttgtgtatggctcgcaatagtgtcggagctgtgagatgctttcttcaagctggctccttgcctcctccacatacttcgattgaccctcaggaactgagtagagtgaaagctgcgcacattaaaacaaaacaaagatttaaaagatgtactgtctacaggatacatttatcaaatttgtaagtatttaatataatatttctagtaattcatgaattacagtgactctgtggtcgggtgtggtggttcacgcttgtaatcccagcactttgagaagccagggcaggcggatcacttaaggtcaggagttcgagaccagcctagccaacatggcgaaacccagtctctactaaaaatacaaaacttagccaggtgtcgcggtaggcgcctgtaatcccagctacttgggaggctgaggcgggagaatctcttgaacctgggaggtggaggtagcagtaagccaagattgtgccagtgcactcaagcctaggcaagagtgagactccatctcaaaaataataataataatacttcatgaattccagtgactctaagggttacaagcaacctgaactttatctcaaactatctctgcaccttatttccataatcaacgaggccaaggccaaaagggcagggctatgaggtgtcctactttctccccacccactgactacaaacaaagcagctcctctttatccattttatatactggtatttggtattccaccttagattgagcttggaaaaaagattttattactctaaagggtgggtgaaggggttaaaaaagcttgagagtaaccaaagggcatgtcattcagttcaaatgattggtctgatgttaatcaaagcaggacagcaggtttattctccacccagagaacttcttacagccactgctggctgccttctttaccctcaaaaatgccactgtgccaaggcctgagaagcgagtaaagggcaaaagataagctaattagctttatgtaaacaccaatctagtaaccctacccaggactgaaggtagatccttacctcactttattcaaaggcaacagaaactgaatatccaaaataattagtgggaagtacagaccaaaaaggaatgtaaacagtagagagaagatttcttgttttttttttttttaaatttagtatttattaagtacatacttatgagcggctcctctagccaagaaacagaaaggatccagatctctaatttcttagagaggaaaaaatgtgaatatattcttggctcgataagaatcaagataagccaagaatcaggcagaccacttagaaaagtgagttgtgcttataacctgttgggacacagtggattccccagtaaacatttataaagtattccttaattgtgcccttacctaagtatcattaaagtttatctgttgaaaaagccatagtttaatatttcccacaaattaaacaaactataaggaaatatattttctctgtttaaatgtcttctggctgggcgtggtggctcacgcttgtaatcccagcactttgggaggccgaggcaggtggatcacctgaggtcgggagttcgagactagcctggccaacatggtgaaaccttgtctctactaaaaatacaaaattagccaggcgtggtggcacatgcctataatcccagctacttgggaggctgaggcaggagaatggcttgaaccaggaggaggaggttgcaatgagccgagatcgcaccattgcactccagcctgggcaacaagagcgaaactccgtctcaaaataaataaataaataaataaataaataaataaataaatgtattttaaacagtcacatcttcctgatatacaatttgtaaaaaattatcctacagtaactaaatcagacactcaaaatatatcgcaacatgaacaacatgttacctcatcaaccttcacggaatttttgggaggtgagtccttttttggtgctgcatagactttgaaggtgagcaagctcaggctggctggccccacggacctctgaattacctgaaatgcagaagcaatcttaaacctctctatgttacagaccgaatgtgcagaacatgagcatattcataacctcagccactccccaccctgaaaggcttactgtgctttattttatttttatttatttttatgttttcaagatggagtcttgctctgttacccaggctgcggtgtagtggcgtgatctcagctcactgcaacctccaacgcccaggttcaagcgattcttctacctcagcctcccaagtagctgggattacaggcgtctgccaccacacccggctaatttttgtatttttagtagagatggggatttgccatgttggccaggctggtctcgaactcccgacttcaggtaattcgcccgcctcggcctcccaaagtgctgagattacaggtgtgagccagtgcacctggcctacaaaatatatttttttaaaaaatcagccaggcatggtggtgtgtgcctgtagtcccagctactcaggagactgaggtgggagaactcttgagtttgaggcttcagtgagccatgatcatgccactacactccagcctgggcaatagagtgagactctgtttcacacacacaaaataatcgctccactaaaaaaaaaaaaaaaaaaaaaaaaaaaaaaagatgggctgagaggaggagagttatggtttattaatttaattgtgaatataaaaaatgtgctggacgcagtggctcacgcctgtaatcccagcactttggaaggcagaggcgggtgggtggatcaccaggtcaggcattcgagaccagcctggccaacatagtgaaatcccgtctctactaaaattacaaaaaaaaaaaaaaaattagctgggcgtggtggcgggcacctgtaatcccagctacacagaaggctgaagcaggagaatcacctgcacctgggaggtggaggttgcagtgaaccaagattgtgccaccgcactccagcctgggtgacagtgcgagactccacctcaaaaaaaaaaaaaaaaaaaaaaaaaaaaattcagacccctcctgcgaaggccgtggcagttttctaggagggacgttgatctccttaggttgtatcctggtgctgctggttctgcctaataattgtgatgggcacaaaccacatgaactaatgtcagcactagctggctaatctgtatcgtggaagcaaaagaaatctgtagcaaaactgcattgaaattaagacctcaagatgcacacttaatacttcaagatgtatcaattgtttttaaaccagttaaagtaacaaccacccttttttttcttaatggctttcagctctttatttgcttctgaaatatgggaatttgcagccatacgtttcaacagatatttttgttatattttagctggcattacgttttgtattacagaatagcctcatctttcacattacaggcactgcaaatctcagtaatatgatttccaagatgctaaatcatgcctaaatagttagagagaaatcaatcactcatttattttccacctctcctccatccatttccttttgtctcatttgagcaggaaataaacaattattgagcatgccttgtgtgttaggcacagccatagaaataggaatatggagtaagacatatcctcaccctgaaagggcttccattctggtaggaagaacttgatagatgtaaataaatggacaaacttttttttttttttttacacagggtctcacactgttgcctaggttggagtgcagcagcaggatttctgctgcactgcaaccttcccatcccaggttcaagcactcctcctgtcttgtctcccaaatagctgggactacaggcatgcaccaccatgtccagctcatttttgtaatttttgtagagacagggttttgccatgttgcccaggctggtctcaaactcctggattcaaacgatccacccaccgcggcctcccaaagtgctgggattataggtgtgaaccactgcacttggcctgggacagattaaaaaataaaataagggaggctgaggcacaagaatcgcttgaacccaggaggtggagattgcagtgagccaagatactgccactgcactccagcctgggcaacagagcgagaccctgtctcaaaaagtaaataaataaaagaaaagtgatacgggaggggcaggcagggaaatgctgggtagagaagggcgtggtccctggctagggctccacccctgggcctgtgcccaccaacctaggtgaggacaggcatttctgtttttgtgcccaaatatcgtatttcccaagaccaccctggcccaccacactcccatcttgtgcctataaaaaccccgagaccctagcgggcaggcacacaagcggctggacgtcaagagaagcagaggcaaggaacaacataccagcagaagaacacagtgacagactccggcaggccaccaacagcagaacggcaggacaacgcggagtttggctgagggcggtcagaggagagcctggctgctaagcggcctgactccaggggaaaaccaccttcccactccataccccttctggctccgtttccatctgctgagtgctacttccaccattcaataaaaccttgcactcatcctccaagcccacgtgtgatccggtttttctggtatactcaggcaagaaccctaggatacagaaagccctctgtccttgcaataaggcagagggtctaactgagctgatgaacacaagctgcctactgacagcaaaactaaaagagcacacgtaacacacgcccactggggctgcagaagctgtaaacatccacccctagacgctgccatggggttggagcccacactccccacgacctgcccatctgcctgctttccctaggggttttgagcagtggggcacctaagaagtgggccacactcccatcacatgccctgtaagagggacaagggaaattccccttgtttcaaaagcatgaattctcccggctcttaggcagttctacagaaagacaaaacaagtataggacattatagacagaggaatcagcatgtgtgaagccacgaagctgggaaacagcatgggagaagtgtagggagttcgagttttgtgggagggagcagagtgacagagagatgagtcagagaagttggttgtagccagatcataatgggactcgtgtggctcacataaaagtcctaggtaataaataccaaaagatctcaaataaggatggaatatagaatcgagtttgccatttagaaagacgattatttctcagtgtggcgctttaagtcattaaagggccagctgaccagttatggtgctgctaaaacaatgaaggaaagaaataagggcccaaggaaagattgcacaggagaggagaaagaggagaaagtagaattgagatagtttaataggcaaaattagcaggacttagtgaccaaagggaaaggaagagtgacgatgaccttggtttaatttttattttcatttattttaatttttaaactgacaagaatcgtgtatatttattgtgtacaacatgctgttttgaaatatgtgtacattgtggaatggctaaattgagctaattaacatatgcactacctcacaaattaatttttgtggaatctaaaaaggttgaactaatggaagtagagagcacaatggtggctaccagggcaagggctggggggagttggggagatattggtcaaaagtacaaagtttcagttaggaggagtagttcaagagatctgttgtacaacataatgactagagttaacaacaatgtattggattttcgaaaatcaggaaaagagtagattttaagtgaccttggggtttccgatgggtttttctagttgggtggtgacacagcattcctgagagaggaagtagaaaaagaggggcaagtctgagggaaaaatgatgagttggttttggacatgttccagagaccgacagacagctagaggtctagtcatctatctatgtatcttttattttacttgaaaagctaaagtaggcaaacttagaaactgttgtcttttggaaattaagaaaaagttgacctgaaattttaagtccataagaacatgttttttgggtctggacttcctcagcacttcaggggtgtatttatttctcataaagcacagtaaggccgggtgcggtggctcacgtctgtaatcccagcactttgggaggccgaggtgggtggatcacctgaggtcgggagttcgacaccagcctggccaacatgatgaaatccagtctctacaaaaaacacaaaaattagccaggcgtggtggcagacgcctgtaatcccagctactcgggaggctgaggcaggagaattgcttgaaactgggaggcaggggttgcagtgagccgagatcgtgccactgcactccagcctcggcaaatatatatattatatatatatataaatatataactatatctatacataactatatatatatagcagagacagggtctcatcatgttactcaagctggtctcgaactcctgagctcaagcaatcctcccgccttggcctcccaaagtgctgggattacaggtgtgagccaacacactcagcctatctttgattttaaatctcaactcatttcctttaacattttattggattcttaattattaatttctactttaccttcccctcttatcttacttgtttttctagttttaatattattctaggcctgcctccctttactgcctaaactgttttcttcttcttcctcttctcctattagttttcctccctaagcctaccctgatacccattccacagcaagaactgtggccacaagggtggtagcaccaaagaaagctggctcctgcagcggccttttcagcttccagcaggctctcaacagacaagcaaacaaaacaaagaaaaagcaaacctcaccccaggagacctgggagacctacaaatgaacactccccaggaccataattcttagtttgcagagaacacatgatttactcgaggatttctcaaactcagcactactgacatttgggttgggtccttctttgtggggctgtcctgtgcactgcaggaagtttggcagcatccctagcctctacccactagatgccagtagcacctcctcccagtcacgacagtcaaaaacatctccagacactgccaaatgtctcctggggagcaactctcccactgagaacctctgatttacttgagtaagtattactttctgacatctctcaccatctagacttgaagaaaatctgtatgttttaaaacccatggcctcaaacatagtgagaaaccagaacaatcactactaggccggggaggtgggagttggaaggaagtggacttactgagaagtggcacaagtgaactttctggggtgaaacaatcttgattggggtatgggttattcaaggtatatacatttgtcaaagctcaaattgtacaactaagactgtacaacttaaaaatctatgtatttcactctatgtaaattagactttttaaaaaatccatcagctctagcacacctaatccatgccaagctcattcctaaggagccagccacacacctgaccatggtaaggaactggtatagatctgtgtgatggaaacccatgggaggagccttggtaaaaggtccccaggtagacatggctgaagctgatgcactcaacatcttggctgattcatcttcctttttagcttcaaagggggctcctcctggtgcgagatgaccccaccctgcctcagcatgctcaccacctttccctcttaacagtaaaaaggaagctggccagaccagatgtcatcacaaatggccatcttcgacactgtgtgcctgccaggtggttatcataatttgttagggctcatattgagtattcaggccaacctattcaaaatcaggatttaagaagggaaaggctaagatgggtagaatcaccccaggacagtgtaagggcacaaagaggagatgaaccttcttcaatcttttgtctccccaaggaagaacaatccagttctttgaagaaacacaatcaactttcagggtctgggacataataaaaaaaaatctctagccttatcaactttcctcctgttcgcactctggatgggttgctttgtgagacatgaacacaaaggtattctctctccatgaggagtcctgacccattatgatataatcggactgaatatacctcccaagaagtgaaatctcccccatactttttctttttccctttttttttttttttttttttttgcgacagagtctccctctgtcgccaggctggagtgcagtggcatgatcttggctcactgcaacctccgcctcctgggttcaagccattctcctgcctcagcctcccaagtagctgggactacaggtgtgcgccaccacatgcggctaatttttgtatttttagcagagacggggtttcaccatgttggccaggatggtcttgatctcttcaccttgtgatccgtccgcctcggcctcctaaagtgctgggattacaggcatgagccactgtgcccggcctcccccaaactttttctgatgcagggctgtaatctctagactgcatgtacccacgccctgagcactccctttcccaagtgatagtccttgagaagccttgttgccaggtacactccctggtcagggcagatgagttggctcagaaaatgagtacatatgcacctgccaagaactgattagatatggtctactttgcattatatgagttaggcttgctcaatcaaagtcaagcaagctctgttaagagctgaatctccaattagtgctaagttacaggctagatcaaaggtggcatttctttagatccagcccctcgggagtatacccttcagttactaaatgcctttcttggcattcagctagttgggggtctcaaagtaaggactctaatgtgttggcttctctgaggttttgaatacagctgtaagacccatagtcacagagaaaacgaaaatttggcttaaaggtaaactggtggcccttagctttgcaaacctcagagggagtgtcattgagttttctcactcttgtggctaactcttctttctttctggtctgatcctactccccagcaaagtatcaaggtacactctatcttggaccttagactctctatgtctcaaaacttttgtttcgcacagcccgcaaggggcttgtcaatggaaacagagcaaccagtattggtgttgggttagatgaggccctaacaagaagtgtaaaggggtaggctgtcatcatcttaaagacatttggttcttactctgtctccactgaagcttgcgaaggactgatgttggcaaaacaaatctggtcaggcaagcaaggttatatataacaattagaagaggtcaaccagggttttatttcaaaaacaaatatttactgcacacccacatcatgtcagacatggtactaaacagataaaacacataagcagacaaggtccctgctcttatagagcttccaggaagcttatgaatttaatcaaagactcaggccacaatttaaaaaataaattaacattcaaaaaaagattcagggcccagcacagtggctcacgcctataatcccaccactttgggaggccgaggcaggtggatcacaaggtcaggagttcaagaccagcctggccaacacactgaaactccatctctactaaaatacaaaaattagccaggcatggtggcatgtgcctgtagtcccagctactcgggaggctgaggcaagagaatcgtttgaacctggaaggtggaggttgcagtgagccaaaattatacctctgcactccagcttgggcaacagagtgagatttcatctcaaaaaaaaaaaaaaaaaaaaaagattcaggcataagattgagtttattaggaggctgaagtgggaggatcacttgaggccagaagtttaagaccagcctgggcaacataacaagactccatctctacaaaaaaaaaaaaaaaaattagccaggtgtttggggcatgcctatggtctcagctacttgggaggctgaggtgggaggattacttgagcccaggaggtcaaggatgcagtgagctataatcgcgtcactgcattccagcctgagtgactgagcaagactctgcctcaaaaaataaaataaaataaaaagattgagtttatcagtcagctccctcagctttaaaggtagattcttagacacagtttaccaagacatgaatctggtaaggtcgtaaacaaacaaatcataatgggtgtccagaaggctaaactgttcttgctttgcaaataaaagtacactgactgcccagaattccatagctctgggatcatgttgtgattatgttccagtaaaactgccttaaagacaaataaaaaccttaagctaaataagtcaccctcagaattattcagactctcatgaatggtggggctcaaatacctaacaacttgctttctttttcaactttatagagaatctagtgaatactctctcccatttaaaaaaagggtgactcttttctcccacaattacagaactattatcttattagacttccatttataatatatgccagcttcatgatagaaggcttttgcaggcctgtgtacacaagaggtttcagaatcacctggggagttgttttttttttttttttttttttttaagacagagcctcgctctgtcgcccaggctggagtgcagtggtgcgatcttggctcactgcaagctccgcctcctgggttcatgccattctcctgcctcagcctcctggtagctgggactacaggcaccagccaccacgcctggctaattttttgtatttttagtagagacggggtttcactgtgttagccaggatggtctcaatcttctgacctcgtgatccgcccacctcggcctcccaaagtgctgggattacaggcgtcagccaccgcgcctggcccacctggggaattttttaaaagcatagattctaacagcttcccccagagtgtctgactctgaatctaagaggggcccaagaatctattcccaagataagcaaagttttgaaaaccaccattccacaaacatatgcttagagaacagttattcaacttaagtttgtataagcactcaaacatacttttaaaaacatttgaaagtataaaatgaaaactgtcctaaatataaaaagaaacagagtgactggccacccactagagaaattatgacatttatttacattcaagaaaatctctcccgtcttaaacaaaacacaacaaataccctccacccctaattccctctctaacaactaccttacccttctaccaacttccattgacaaatttattttaaaagtagactatggttagaaggcagaatagtggatacccttagcaagctgggtagtgactagaagggccacgagaagagcttctagagtgctagtatgtttagtttgtaaaaattcacttatgccccgtttactttcctatatgtatgttatacaaatggtctcagacttacaaatggttcaaccttacatggtgcagaagcgatacgcattctgtagaaaccgcactttgagtacccatataaccattctgcttttcactttcagtgcagtattcaataatgtacatgaaacattcaatagtttattataaaataggctttgtgttagatgattctgcccaactgtgggctactggaagtgttctgagtacatttaagggagggtaggctaaattatgatgtttggtaggttaggtgtgttaatttttgacttaatgatattttcaacttatgataggtttatcagaatgcaaccccaccacaagctgaggagcatccgcatttaagcacaaagtcaaaaaggcagattctgtttgctttctcaattttatctcctcctccctttactactaaatgcacctaaaacctttcttcccaagaccaccaatagcctcccagttgctaaaccccactggacatctggcatcttggttgcaccctgaaactggtgactactctacatcttcaacccctttctttggcttacaggattctaccctatccccattctagaggctttctaggtactctctcctccccttttgggccttctcttcctctgcatagctcttcaaggttgatgagtcatggagtagtctttaactctctcctcttctcactccagggcaatttcattaaaatctaattctttcttttttttttctttcagacagagtctcgctctgtcacccagactggagtccagtggcctgatctcggctcactacaatctccgcctcccgggttcaagggattctcatgctttagcctcccaagtagctgggattacaggcgcccgccaccacgctcagctaatttttgtgtttttagtagagacagggtttcgccatgttggccaggctggtctcaaactcctgggctcaagggatccacctgcctcagcctcccaaagtgctgggattataggcgtgagccaccacacctggccaaaatctaagtctttaactcccactcatatgctactgatgctcaaatcagtatccctagcctgggcctctccctaagcctcaggcttgtgtgtttcctgtgtttctaactccctgagggacatgttaccaggcttttcaactgctacttcaaacaggctatatccaaaggtgaccttttttttggagtgatggaatatattatttctattttccatgtaaataatttaaactctctctatgtaagtatatatacacttacagtatcttacccttctaccaagtttatatatatgtatataaactatatgtatatatatacttatagacttatacatactatatatacttaaaaatatagtttatatagtttaagtatatataatactttatgtatttctatatatagtttacatttatatatttaaaatgtatgacattatgctttcaactatctttctccaaaactgtttttatgagattctctaccttatttaatgatcctacaagccacacaaaggacaacataaaagcaactctttaatgataaagaatgaaaataaatttttttttttttgagacagagttttgctctttcacccaggctggagtgaagtggcgcaatctcggctcaagacaacctccgtgcccctggggttcaaacgattctcctgcctcagcctctcaagtagctgggattacaggcagccaccaccacacccagctaattattttttttttttttgagacggagtctcgcactgtcgcccagcctggagtgcagtggcgcgatctccactcactgcaacctccgccgtctctcggattcaagcgattctcctgcctcagcctcccaagtagctggcattacaggcgcccgctaccatgcccagctactttttggaattttagtagagacagggtttcaccatgttggctaggctggtggtctcaaactccttacctcaggtgatccacctgccttggcctctcatactgctggaattggccaaggtgggcagttcacgaggtcaggaaatcgagaccatcctagaaacacagtgaaaccccatctctactaaaaatacaaaaaattagcagggcatggtggcgggcgcctgtagtcccagctactcaggaggcagaggcaggagaatggcgtgaacctgggaggtggagcttgcagtgagccaagatcgcgccactgcactccaacctgggcgacagagcgggactccgtcacaaaaaaaaaaaaaaagtgctgggattacaagcgtgagccaccgcgcctggcctcagtcaaccttttctgcaataatttccattctgacagcatttttcactcgaaacaaaactattttaatctgattctaattatttaggaggtaaaaatctgaaatgggttttttacaaaaaaaaaaaacaaactatgaacactgacaatacttttgagattattcttattctaagtaaccaacacaaaaaaaagaactatgtgaaagaactcagaatacaacaaaatgatgaagacaataaaaaaattttgtcaaaatcaggctacactgttgtcctcagtaacgtgttgtaaattgaatgaaaaatcaagagaaaggccgggcgcggtggctcacgcctgtaatcccagcactttgggaggccgaagcgggcagatcacgaggtcaggagatcgagaccatcttggctaacatggtgaaaccccatctctactaaaaatacaaaaaaaaaaaaaacaaaacattagccaggcgtggtggtgggaacctgtagtcccagatactcaggaggctgaggcaggagaaaacctgggaggcggagcttgcagtgagccgacatcacgccactgcactccagtctgggcgacagggcaaggctccgtctgaaaaataaataaataaataaataaaaataaaaatcaagagaaatgagtccacaattcttgaaacgtcaaaagaatacagaatactctcctccataaggagcattcaggacagtatctacattttatacagcaatcttttatttttatattttttattttttgagacagagtttcactcttgccacccaggctggagtgcagtgccacaatctcggctcactgcaatctccgtctcctgggttcaagtgattctccagcctcagcctcctgagtagctggaataataggtgcctgccaccacgcccagctaattttttttgtattttcagtagagatggggtttctccatgttggccaggctggtctcgaactcctgatctcaggtgatctgcctgcctcggccttccaaagtgctgggattataggcatgagccaccatgcccggccagcaatcctttctaacatgtagggccacacaccaaacagaacagaggctttctctggaaagggggctggggggaggtggacaatagcaacctgaccaactgtactattttgactttttacaaggaaaagtatttcagtattacttacaacattttttttaaatagatgttttcttttcaaagcagttaccttgataaatcatatatggagtcggaatttactacaactatttatataaatttcataagtgaaatttattttttaaaatttattttattattattattttttgagacagagtctcgccctgtcacccaggctggagtgcagtggtgtgatctcggctcactggaacctccgcctcccgggtttaagcgattctcctacctcagcctcccaagtagctgggattacaggcccacaccaccacgcctggctaatttttgtatttttagtagagacggggttttgccacgttggccaggctggtctcaaactcctgacctcaggcctcccaaagtgctgggattacagacatgagccaccacacccaaccaaaatttacttttaatatgtaatcatatggcttccatttctaaatgccttcagatcacattttaagcctaaaagaaaatcagtctcggccaggcgccgtggctcacgcctgtaatccagcactttggaaagccaagttggttagatcacctgaggtcaggagttcaagagcagcctggctaacatggtgaaactctgtttctactaaaaatagaaaaaattagccaggcatggtggagtgcgcctgtaatcccagctactcaggaagctgaggcaagagaattgcttgaaccctggaggcggaggttgcagtgagccgagatcatgccactgcactccagcttaggcaacaagagtgaaactccgcttaaaaaaaaaaagtaaagaaaatcagtctcgatatattttaaataagagtggtaaagaatagagaatgggccggattcggtggctcgagcctgtaatcccagcactttgggaggccgaggcgggcagatcacttgaggtcaggggttcgagacaagcctggccaacatagtgtgaaaccctgtctctactaaaaatacaataattagctggtgggcacctgtagccccagctactcaggaggctgaggcaggagaatcgctcgaacccaggaggcaaaaggctgcagtgggccgagatcgcaccactgcattccagcctgggtgacagagtgagactccgcctcaaaaaaaaaaaaagattcattatctccacacacacacacacaaagatgagaaaatggcatctgtacgcctatgtttattgcagcactatttacaatagcaaagacttggaagcaacccaaatgcccatcagtgatagactggataaagaaaatgtggcacatatacaccatggaatgctatgcagccataaaatagaatgagttctttatagggacatggatgaagctagaaaccatcattctcagcaaactaacacaggaatagaaaaccaaacatcacatgttctcactcataagtgggattgaacaatgataacacatggaagggaacatcacacactggggcctatcaggggatggagggcaaggggagggagaccattaggacaaacacctaatgcatgcggggcttaaaacctagatgacaggttgataggtgcagcaaaccaacatggcatgtgtacctatgtaacaaaccttcatgttccgcacatgtatcccaggacttagagtaaaatagaaaaaaaaattacaatattagtcttcattaaaacaatctctactggaaccttttctacatctcctaattaaacgtagtgtccaacataaacttttctttctgttgtggtggtggtggcggtaaagaatcaagctttatgtaaacttggtcaataataagattatctcattctactaaaaaaaaaagaagaagaagaaaagaaaatggcattttttttaaaaaaaaaaaagaggaaggggacttgtagtatgattccaccgagttttttgaaaatgtcataccaagggtatatttgaatatgtccagaacggagtctaaaaagatgttagggccgggcgcagtggctcatgcctgtaatcccagcactttgggaggctgaggtgggcagaccacgaggtcagtggttcgagaccagcatgaccaacacggtgaaaccctgtctctactaaaaacacaaaaattagccggacgtggtggtgcacgcctgtaatcccagctactcaggaggctgaggcaggagaattgcttgaacccgggagatggaggttgcggtgaacgaagatggcgccactgcactccagcctgggcaacagagtaagactccgtctcaaaaaaaaaaaatatgatgttaacagtggttgtctataggtggtgatattaaaggtaattcttatctctatttcctgaagtttttacaaaaaaaccattgatttgttttgtaacatgcaaagaacaaaaatggctagctcctgaggatattataaaggtttgccacaaagtttgaagataattccaaatgaggaagagtaaaaatgttttgatcagtgatagaatttttggaataaatataatgacagtataattaaatctatcctctcaaaacgactgttttgatgcattcatttgaatgtaaaatttgggagcactcatactttaacaataacaataaaacccacaatcatttcgatctgtttcacagcaaaggaggatataaagccaagaatttatctccctttgtcactcaggctggagtgcagtggtacaatcatagctcactgtggccttgaactcctgggctcacctaatccttctgcttcagcctcccaagtacctaggactatgggtgtgacggagcacactcagctatttttttttttttttttggtagagatggagtctcactatgtttcccaggctggtctcaaactcctggtctcaagcaatcctcctgccttggcctcccaaagcgctgggattacaggtgtgaaccaccatgcccagtaaagtttagacttcaaacaacattaaaaaaactcttcctaatacaacaaacatagaactattttatgagaaatttttaattctttagttctgtactacagtaattggtatttcctagctctttctcatccactgtaaacagactacaatctaaagagataagcagagaaaaaaatgaggctgttttcaagactaatattatctttttctcacagaaaaccaagttctgtttcatctttggagggtagaattcaccacaaaattaggtcagcaaagcaaacaaaatgtctcatctgcaattgtttcattttctactctttaaagatagcgattagattttataaaattcatgtagaaaaataataaacttgtgcgataaacaggaagaaaaccttagggccaaagagtgagataattgttcatttaggcaggttttgagtcatccagttgggctatactggttttaaagacttggaacacagataatatgtaatttatcaagtccagaatttattttgaacttcctcatccagacagaaatttactgctacttaagactcctatatatatgtgtttttttctctattagaatggcatcctgggacccactcaatcttttctgaattaaggaaatatagggaggaaaaaatcgttgggaaacatttacttcaagtttagcttttcaaatgcatctgtgtttccaagcaactaataaaatgtacatcatttaataggagagctagtctgtcaaagtaaaatctatctgggcagggcatgctggctcatgcctgtaatcccagcactttgggaggccgaggtgggcggatcctttgagcccaggagttcaagaccagcctgggcaacaggctaaaggtgaaaccccctctctacaaaaaatacaaaaaattatctgggaatggtggcacgtgcccatagtcccagctacccaggagggtgaggcaggaggatcgcttgagcctgggaggtggaggttgcagtgagctaagattgtgccactgcactccagcctgggagacagagcatgattctgtctcaaaaaaaaaaaaaaaaatctatctagacacaggtttctatctagacacatggctctgtctcaaaaaaaaaaaatctacctagacatgggtttcatatctctttttttgttgttgttttttttgacatagggtctcattctgtcactcaggctggaatgcagtggcacaatcacagctcaatgcagcctcaacctcctgggctcaagtgatcctcccatctcagcctctcaagtagctgggactacaggcaggcaccaccatacctggctaatttttgcattttttgtagagacgggcggggtttcgccatgttgcccaggttggtctcaaactcctggactcaaggaattctcctgcctcagcctcccaaagtgctgggattacaggtgtgagccaccacgtcgggcctagacccgggtttcatatcttaacagaccaccatgtgcacagagaactctaaactcactaatgaaaactgcctttgacttcatctcagttattcatgtgcgtttttcttctttaaggaaaactgtaagccttttttggaaaaaaaaaatcatgtacaagactcaattcggttgataaccatctgacctcataatgaaaatctgtgcaaaaataaggaacaaaaacaagtaaagtaaatgtttggactatacccagcaactttaacaggactcccaaatggtgtgactccacaaacaggctcagttctatctgccaagtgaggtaaaccatcaacagacaatgtaggaaacttcttggagcccgtataatcactttttgcttacttactcactcaccagtctaacccatgtcacatgaatcagcatctctaataggagaggagactcattttcagcaagcacaaacaaaaacaggctagttcacaaggactgaagtttgtggaatgggggaaaagaaaaaaagaacctttattagttagtttcatatattccattttaaaagactgttcagaagaaggaatagacttcttttcaggaatatctgaaaaaagaaactactgggaattcctccacactaaggcaatgaacatgcacttgtggatctatctctagctcccacagagggggctcctcatcctcatggaaccaaacaaagaagtccttaagcgggagccagtgtgggctttgaataaaacacgctgcattgcttcaaacagccagaaataggaagacaaaggataactgcacttaaagtgcctttaaaacaatattcacttaaaattcaactatactatccataatgcataaagctgtatcaggaaaatatagcttaacaatcaaagtcataggctttcagcatactgaaaactctacgacccttgccctacattcctgcttctccaagttttagtgaacactgaaaataagtttaaaaacctaccacattaagaaattggcactgattaaattttctaacaaaactggcatgaggctatgcaaaaattaggaaaaactcagcaaaagtgaaaaataaataacttccaaattctaaaatataactttagactaggatttttttgtccctgaaaatatataaagtttcatgctgtatgaactaactgtaaaattccacttaagcattattggggaaaatcaactgatacactctttcaattcctttattttaaagatctcttagtactttcttgtcatattaaaaataagtctaaactttttgaaacagatatctttgctattgagatttattacacacctaataacatgcatttatatatctaattttaaatgtacaatacaaacaaatatgcaagttcgtttcctagcctctaagaagttccagtctagcctagaaaggacatgggtgtggaacacatatacatatagattataaattaaacctttacgtcataaaagtctacaaatatcaacaggcctcatggggtaatcaattcatttatcataaatgtctggtacatcatctacttttctcctccactgtgcctctaatctctccgttcttttaatgtatcgttttacttcttctttctcctcttccagtgttagttacaactgtgaggctatctgcatttcagaagtagatagaagaatgctacagtgtcctgagcagaattcatttccaaatgagaagtgaaataacccaagttaattcacgttttacagttgttaagtccagagtgctaacctgcaagcatagattacttcagtggacaaatgtgatacaagaggaacagaaaacaccttacattgatatagtgctttgtagttcacggttcttttcgcatattatctcaattgaatctcccaacaatcctgtgagatacagagggacatactactatccccacaggatcatgatcagaggacgctgagagattaagaaatctcaactggcccggcatggtgactcatgcctgtaatcccagcactttgggaggccaaggagggcagatcacttaaggtcaggagctcaagaccagtctggccaacatggtgaaaccccatctctaataaaaatacaaaaactaggccaggcgtgctggtgcatgcctgtagtcccagctacttgggaggctaagggaggagaccggcttgaacccaggaggcggagggtgcggagagccaagactgcgccagtgcactccagcctgggtgacagggcaagactccggctcaaaaaaaaaaaaaaaaaaaaagaaatctcaacaaggtcgctcagccagaaacacaactagaacctgaggctgaaaagattgcatccagagctacagagcagttttttcttcgtctctgtgatccactgtctaacttcttcgaaaggtaagaaaggaaaaagaaacaaccaattgattctgcacataaaaaatgtatttatgtgagtaaaaatgtagttactataattcctcaagaagaattcccttgaagatgcttaaactgttagggaaaaaaaaccttcattatctttccaaatatgtggcttttaaaataatgctcaagtataaaagttacattactcttccaatttacagatgattttccttttccatttagcattgtaattctccgcgcagttctagtaacatactagtaacatggtaagaaaattaatttcaggaagacaggcaatgtaagtattacactaagccacaaagaatgtgtgaggtaataacacctcatagtcatggacatgttcactcaggctccttggtgtggtgagctctgagtacaggtcatgttatttgcccttgaggaaggaagtgacacagaccagttttcactaggccaccttcttgccctggaggcttcagttagcagctgatgatttcccaatttccagcccacgtctgtggcaggaaaagtccataccctggggttctacatcaactgatttcccccttccaatgcccagatatttcagcaagcccaacctgttcaaaaccaaaccatcacctccccctcaaaccaaattcaaccttcttccactttcccacctcaatgaatagttcccacctcaatgaatagatcccacagtcaaaagtcaaaagcctgggcagaaaccttaatttatccttctccctcatctaccacatccaactgactaccaagttttgaaataaaaaatacttttggagagccccaagaccgtgcaccaccgtaacacaggtagttacaagatgccatcttacaagatgccaactaaaagtaacagctcacatttcttcagcccttactttgggccaagcactgttctaagctttgcgtaggaatgaatttaatccacacaataatttgaggttggtaagcatctcatccttgttttacaaatgaggaagcagctacagaaaactttagtatctctcacaaggaacacagtgaagcccaaggtcttaacactgttctgaacactctcacacttctgtgtccttgcatgtgcttttcttctctgtttggaaggccctttcaaccttgtctgcctagctccaaagatcagcataggcatgttcttctctataaagccttctgatgccccctgctgttgctcttccctctaagtcagtagatctcaaggctggctgcttgctccaaaaactagatgcctaatcctacccctagagattcttgatgtcattggtataggttctagactgggcatcgggacttttaaaagctccccaggtggctctaacatgcagtcaaggttgagacccactgcatcgttaacggacctttaatgtctgtgctggtaagtgcattgtgagcttctgaaatgaaagtttcataatcaccttggggggctttttcaaaactagcagttcctggacgccaactaaaaagtcagtcagaaccatgcgcaggggcttggaaactgtctccttgaataattctgatttgtggccagatttgggacctctctcctagataagaactgggtcttttcacttgtacccaccagggtccagcatgatgcccagcccatagttggactaggataaaatctgtgtaatgaaggaaatctaataacgtgaatctgggtatatgtatccaatattcaaacttcctgcagcagcacaaggaaaagctgcttcctacaatggaatgcaaatactgggcagcttttcaaatgtgttttttaatccaccaatgccccctagtgacctgaagatgaataactatatcaaaacatcgcagtatatattttaagtacaatgtgtacttaatatgcacataactagtcagacacactgcacttttactaccattgtacttttactaccaacacctatactattaactcctttgccctccagttctagttaacccaagctgttaactcccaaaccccgatcaatcctaccgtttactccatccccactctgcacaaacatacaggagtgctctcagcagagccctcaaagggtctggcctatctttttgttccttggtcagtgcctctcccaaatcccaccatgttcataagaccatccatctcgaaaacacaagaaccattcatctaccgattggcttcaattcttgctagtcaaaggggaccaacgaaaactatagaactagttaaaaaatggagaatctggccgggtgcggcggctcacgtctgtaatcccagcactttgggaggctgaggcgggtggatcacaaggtcaggagtttgagaccagcctggccagcatggtgaagccccgtctctactaaagatacaaaaaattagctgggcatggtggcgcgcacctgtcaatcccagctactcaggaggctgaggcagaggaattgcttgagcccgggaggcggaggttgcagtgagcagaaactgcgccactgtactcaagcctgcgtgatagagcgagactccatctagaaaaaaaaaaaaaaatggagcatttgaggccgcatcccagacctactgaattggaatccattttaacaagagtcacatgcccattaaagtttgacaagcactggttctcaactactagacctaacatcaccattttatgacaaatattttctgacactcttctggtatcctgaaataaaattcatcactaagttacatgcataagtccaaaaagtaaatcagtatactctgatggtagcataaaggtgaataaaaaggaaagatttatgtgaattatatttcagtatgtaaatgttcaacacaactaaagacataaagaacaaccccattttcagttataatttttgcaaagttaaaaacgaaaaaagaaaaaaagaacaaccccacaagtttccaaaacataccattctgttgagtcgtaccattctatggagaaccactggtctacaatctctcgcacctttcttttccttccatctctcgggtgggaatatctctcccttgcacagctgaggtattctctctagaatcttgactgaacatatccttctagttaccaaattctctctccttcccttgatagtcaagcttatcaaccatcatagtgtccacttacttggccctcagtcaccaacccaggttaatctacccttcacttccatcagtaaacctaaagtataaggatcatgaaagctttccaaagtgcccaaatcagtgaacacgactcatgatatgtaactaactcatatctcatctagcttatatctccgtcatggacattgttggttgcatatccagtctctattctccctcttccttcctaaaagaactccattgtgttcatgaatgcattcctctcccctgtgattaagtgacgccaccctgggttgatcctgtttagtctaagccaatcagatcatggcattcctctgacaactgttacagggtcagacaactgacctaagttggtccaatcagactgaaggaccaagtgtgggagttttttctctctcctcctcctcttgctctagagaatgagaaagtgtgtatgttactagtagtcatcttgcaaccctaaaggaaaccaacctgactgtggaaacccaagaagagatgggtccttgatgacactggttttttttttttttttttttttgggacggagtctcgctgtctcccaggctggagttcagtggtgcgatctcagctcactgcaacctccgcctcccgggttcttgccattctcctgcctcagcctcccgagtagctgagactacaggcacccgccaacacacccggctaattttttgtatttttagtagagacagggtttcaccatgttagccaggatggtctcgatctcctgacctcgtgatccgcccgcctcggcctcccgaagtgctgggattacaggcgtgagccaccgtgcctggcctgacactgttgaccaactgaatcagagcctggaatccattcttcctctggactttgtgagagaattttccttactatttaagcagttgggttttcccagctgaaagcatcctaacatagccatttctccttgaaacttttctccctcgattttctaaacatcactcttttctgctcctacttctgcttctcaagtctggcctccccctttcctctgcctactcctacattttggtgtcctccaaggtttgttgtgatcttttctacccaaagtacatgttcacctgaaataatctcagttcagtcgggcgcggtgggtcacacctgtaatcccagcactttgggaggccaaggcgggcgaatcacgaggtcaggagttcgagaccagcctggccaacacatggtgaaactccgtctttattaaaaatacaaaaaaattagccaggcgtggtggcgggcgcctgtaatcctagctactcagaggctgaggcaggagaatcacttgaacccaggaggcggaggctgcagtgagccaagatcgcaccactgcactccagcccggacaacagggccagactctgtctgaaaaaaataataatgataacaataataataataataataatctcagctcactatgtctttcccttgacacatcaaaactgagcttccagcacttcccccaatggaataccactgatgttccccaccccttttacctgaagaactcctacctgtctcaaaactaaatttaagtgtcccgtctgtgaagccttctctgaagtccccaggggttccttacctttttttctgccgtggacctctttggccgtcagtgagtcctatagactccttctcaaaataatgcttctaattgcatacaaaaaagtcccaactatattgaaataatcttattttttaaactcaaatatctgatataagcagtatgtgcttctttactagcccactaaacaaaaagatctagcagtgagtcttataactaccatagttctgaagtagtaatgagcataagtgatattttgacatctgcaacaactgtaatgtaatatgaaaatgtctgtgacttgtgctggtactgtgacttctactggtaacaggtactgctaatactactgtgatttgttacagtaggaacttgtaaaatgaatggcccccagcgaagtgcaccaactcatatctatgaccttgtgtggttccccaccatatcaactctggacttggctacgtgacttgttttgacatcagcaaacatgatgctgtgtttgtgccttgggacttgccctcttggaagtcagtaaccaagtgaggaagtccaacctaggcacatggaggggcaccaagcccccagacatgggagtgaagccaactttcagtcaagtcaccagcagaactgcccagccaacccagattttgagaaacaattcttgttttaaggcactggtttgcagtgatttgttacccaacaatagataactgagacattacccatatgcgtaactaaaggaagtgctcaattccaattggagattgctaaaaatagttatgttttttccccatcaaagttcagggatcctctgaaatctatgtgcagatcctttgaggagctgagggccccaggttaggaacccctggttaagccaagtggatcctgctctcctttttactactttactacactgttggtacacatatagttaaactggccacagcatatctttccttgttgtaaccctgaaatggagctgagctcctagcacataacaggtgtttaacacacaaatttatcaaatgaatgttgattataggatctgtcttcctgactaaactgtgagctgcctgaaaacagagtaagagcaaatactaggccttttccaagtgctttacacataccaacttactccttataacaaccctatgaggtagatgttattaccccaacttcaccaaaggaagataggcacagtgacttgcccaaggtcacacagctagaaagtggcaatgccaggactagaaggcagaatgcatgttctgattttacagcctttattaacgtacccaaagcacattgcagagctcaataaaacttttaaatgaatagtacaattctgagatttcattagcactattttatgggtactatgcttcttgaagactcaattttgtagattaatttctggtagcctgtgattttttatgacaaaatacatataatttactttttaaaaagtagaataatggctttatgctaaagtgcagattttcgaaattaagtcttcatcgtaaaagtcgatttttttccaaaggacacgagttcacaaaacgcagggaagggggtccactggcccgtattaaataatgttccctgaggagtggagcaaagctccagcttccctcgtcacccagccatcccaccccagcctcccccataccctgcacagcttctcctaaaatgaccctcccccatccacacatcaggttctgaaacctgaccctgccaggcaactaaagccgcgaaccccacagtgccctgagctggcctcaccctacccacgatcccaagagggtactagccgaggggatgggtactttgggggaaggcactttaaattttcaaagtgtttaattcacgaaagcacaacccaaagggccgcccccacccacccgggggtctcccgcctccgcccggcagccgctcatccccagtagaccagtgaatgaaccgcggggccgggacgcagccggcccagtggcgggaaaagcctcggggtgagccaggcctggctgcagagaggccccaagagagcgcggggagggctcgggcggccgggagggggcggtgacagctgtgactcgactccacgctctcaccttgaacatgtcgctggcagcggaggctccggcagggtcaccccggcctcggccacgcccactatagagaggtgactacggaggcccggtagggccttgatttctccaaccgcaagcaggcagcggtgcgggtgacggccgtactgcaaactcggtgcggcgaaggtttagttcaatcacccggttctagaagccgcgtcgctgagccgcagcgcgtcgcgcccgggcagcgggtgaacgcaaaccc

SEQ ID NO: 1325 - DNA, 74593 bp, Homo sapiens; identical to SEQ ID NO: 1324

SEQ ID NO: 1326 - DNA, 72496 bp, Homo sapiens
cagaaaagactcagaatccttgacgcagttgcccgaacccggagctaagttacccgcagggccattggaagccctccctggctttaggtttctcctccagtggaaccggtgagtcctctgcagctctggaccttccatttggttgatggtccttggttcattctgagctgtttttctacctcctttttatttttctcctaggaagttgttgtataggatcctactttaggtttggtggtgcattctaaatggtcttctccactgcccttttccccccaaattaatgtcgattggcctgtgagtacatttgcgtgagagactgaactgccacttttgtggcataattttgaattgccaaacgagaggctgacctcctcagcttggaaaagaaagggagttttgctcctcctagccaaaaaccacccctgggtggtaggggttgagtgggagtctctgggggattgactcctgccatgatgtgcagtgaccctacagggaaccacacaacaaaattaattttaagaggctcatccaggagacaggtgtaagagctgatcacttgctatgttgagccctgtcagaggtctagacctctggagagagaaactcagacacgtgaaagggtagaaagactcagtggtgacacacagtgtagtccctctcacagccagcacacttcaatccaccctactaaaacccaggccacagtttagttcctcattttaaaataaaagtgggagacatagcatgtaaggatgaggaaaggcggagagagcgacccccatttgggcaccccttttggttctctggttcctctacttgcaagtatttgtgtaagcgggaaaagcttgagggcatgccaggtcaaacaagaagcttcctgttacatattatgtctgtgcttgttcacactttaaactgctgcacacattacaccagagaaaattccagcccaaaggtcaacctgcaaccaatcagttcctaagtcctctattttgctattttcttttctgcctactttaaatcttctgtttactttttgttcttttcttttcttttctttttctttttttttttttttgagacagagtcttgctctgtcacccaggctggagtgcaatggcgctatctactgcagcctctgccttccaggttcaagcgattctcctgcctcagcctccccagtagctgggattacagacgtgcgccaccacgtctacgtaatttttgtatttttagtggagacaggctctcaccatgttgaccaggctggtctcgaactcccgacctcaagtgatccgccggcctcggcctcccaaagtgctgggattacaggcgtgaaccaccactcctggcccttctgttacttttccactgctgttgagatagaagtcactgttgggatccaacctttttgtttgtataaactggtgagtttgtgttgatatctcttgctagagttctgaagtaaaagctataggatctttgtgtgagtgtgcatgcgtatttagatgtgtttatgtacatgcacatatgtgtgcacatatacattttttacgtgctttagccctgaagtgtcaaattggcttcaagtcaaagagtactcataaattaaataataagccaaaacgcttttcaagttcacgtgacttacataaatctttaataaataagctggctttaaaattattggtacgatagtattagaaatatcttaaaaattgtcagcatacatgtttgtttgcatttactgatcaagcagtttcatatttacctctgacagatattataaggtgtcaaaatttggcataaggcttacaaaactataaacccagcaacccagcatgaaacacaataatctttgtttctgtactttttgagaaataagacgtttaatgttattagtgtagtaaaaagagctaaatcccaagttatcagtaaaatatatatatatttaaaatttttgcttaggcaaacacagaaaattcatagactataaaaatggttaacagggaaataactttaaatgatgactatcagagttttcacagataatctaggtaaaagattttataaaattaattaggtaaatgtaatgaaacaaatgcctgtaaataaatataatttagaatctaaagttaaataatagatattcactaaatgtctgggccattttcaatttaaataaattgtattatagaaaaacttttctaaaaaatatgttcttattcaaagctaagttattttcatctaattccatgtttatttatttatattttttgagatggagcctcgctctgtctcccaggctggagtgcaatggtgcagtctcagctcactgcaacctctgcctcccaggttcaagcgattctcctgcctcagcctcccttgtagctgggattacaggtgcccaccaccatgcctggctaatttttgtaattttagtagagataggggtcttgccatgttggccaggctggtctcgaactcctaacctcaggtgatccacccacctaagcctcccaaagtgctgggataacaggtgcaagccaccgcacccggccagattctaggtttatttaagggttatttatgaaatatggtaaaaggaaccaagaaacaagagatgtaaagaaagttaggctgcgtgcattgggtcacacctgtaatcccagcactttgggaggctgaggcaggcggatcatgaggtcaggagtttgagaccagcctgaccaacacagtgaaaccccacctctactaaaaatataaaaattagtcaggcatggtggcatgtgcctgtaatcccagctactcaggaggctgaggtaggagaattgcttgcacccgggaggcagaggttgcagtgagccaagatcgtgccactgcactccaggctgggtgacagagcgagactactccatctcaaaaaaaaagaagaagaaagttacaaggaggtatttttggtaagaaatgttaaaagaaaaataattttgtatgagaaagaatcttgttgtttaagagagatgtttaggacagaacagaaaatccaagcaggttgtatatggtctgtgcaagtcataatacagtctgtaaaaaaggaattcaaaaaaatttttatgtaattaagtttgctataactaaaaggaaattataatcattctaggtattggacttcaataataaaaatacagtaatgcaaaaggagatcattggttagaacaagattttcttaaaatactgatgtactcagtgaaattgcaagaagttttttatttttgaattccataatctcttcttgaaattcttcagatggacatcctaggggttccacttctgctgcatcctgcttgcctcagagctttccctcttttgaaaaggcctgggatggtaactctctccttcaacttttgctggctcccgtaattttttaaaaattaatagtctaaaggaagagagagaatttttgaaaacaggcaagtgaaaaatgttataggatgtgcctctatctgtgtgtctgtctataagtttatttattgtctgtttgtttgattgatttgtttattttggagacagggtctcactctgtcacccaggctggagcgcagtggtgtgatcttggttcactgttcccttgagcactgggctcaagggatcctcctgcctcacctcagccatccatgtagctggaaccacaggtgcatactatctcgcccagctaattttttgtattttttatgtagagatggggttttgccatgttggccaggctggtctcagtcctgagctcaagcgatccacccgtcttggcctcctaaagtgctaggattacaggcgtgtggcaccatgcctggccttgtctgtaagtttctatctgtcatgaggaagtaatatttcagtaccaaattatatgaaagagctctaatcaaatggcttaaagaaaagtaagtgcttatcagacaaccaaaagctagctcagatgcttttaattgacattcctttagtaatctttggtaagactaatttggtaaatttaatttcaaaatcctgtccagtggtttaaaatcttagagtcacgttagatgggactgttcccctgaccttgacccccttcgtgggcaggaactggagtggctcatgttactcagcctgcagtttgtggacagctatgtgttaacagctcagtgaagggtcaaggtgacagccttctgcatctgtccttttggacaccgacttcttgtttggtgtccaagaatcatcaggtcacacaaactgaaagatgatgaatgtggaggactttattgagcagtggaagtggctcttggtggaagaggagctggaaaggggatggtgtgtgaagaaggtgatgtttctctgaagcctagccttctctggctgggctcccctccaaaaccacaccgtctgaagttagtcatgtttatctgtagtctccaatgctcagttacttctctgctcgccactcagtagcttgtatccctgccggtcagctgcttgtgttgcttttttctttttctttttcgtttttcttcctgccagctggtctggtccttatgggcacaggatagggggcagggcaggccaaaaaggcaatcatctgggcagagaaacgaggtcagctgctttcactagggccgagcttccagacttgaggttgtagtttagccgggagcccagccatcctgtatcaatgttagattaaattaggcaatcctaggttttgcactggaaattagggttactgggagttggaatagtaggagagtaagatgtatttttggtgaggtttataaaaacacaaagatgtggtttttgccaaagaaaatgtaatgtttagaggctatttaaaggtcactttaaaataaatggaaaattatgtagataaaactcattggagaaagagaaaaataaagaggtggggaatgagaaacctttgacttttgggtggccacgtggtcacacatggtaatgaagtggcatcattttctggggtaaatacccgagattcattgtctcatggccacagaaatcgaggacgtggacacacagaatgaggttgagagcagaagtttagtaggcaaaagaaagagaagagctctctgcagcagagcggggtcctggagaagtgggttgctgcttctttgctgaaatgcagcaagttttatagatgagcttgaggaggcagtgtatgatttacataggacgcaaaagattggttggaccaggtgtaccattttcatagggcatgtaaagctggttaggactagatgtgtcatttgcatagggcatgaaaagctgggctaatcttttttttttttttttttgagatagaattttgctcttgttgcccaggctggagtgcaatggcgccatctcggctcactgcaacctccacctcccgggttcaagtgattctcctgcctcagcctcctgagtagctgggattacaggtgcctgccaccacacctggctgatttcgtacttttagtacagatggggtttctccatgttggtcaggctggtctcaaactcctgacctcaggtgatctgcccacctcggtgcctaatcttttattatgcagatggactctttacctggctagtgccatgtcgcctgttttttttgtttgttttgttttgttttgttttttgagacggagtttcactcattttgcccaggctggggtgcagtggcgtgatcttggcctaatgcaacctctgcctcccgagttcaagcaattctcctgcctcagcctcctgagtagctgggattacaggcatgtgccaccacgcctggctaatttttgtatttttttaagtagagacggggtttcaccatgttggccaggctggtctcgaactcctaacctcagatgatccgcccgcctcggcctcccagagtgctgagattacaggcgtgagccactgcgcctggcctctggttttttactgtacacgtggtgacaaagaaaagggaagacggagcctccatgttgaacatacctggcttccaggtagccctttcccattggcacagctgccagcatttacccattcaagcttccagcttgcttattatctatgcctgcagctctattttccaggctgctctttgttaaaaagaaatgatttgggggctcctttttaaaaagggaaattctgccaaggactcttttaccctcactatctgcctgaataatttctttctagttcctctatcagtaaggagatgcagctggcttgtcttcagtcactaaaggtcaaagccaccagaggaatttagagatggatcctactcatagtcccagggaatttcgttcactggatatatagcaaatgcaaattaataaggaaaaagtgaactattcaatcccttgcttactgcctctgtagttgctaaaatgaaagtaaaagagtgctgccttgggcgtgaaggcagcaccaagctcagatgtgggtctgtctcagatcaggccagtgacctcaaagcttcctacacaaggaaaaattaagccacgtcaaccaaaagttacctctgagacctgtgattaccaagaagatagacatgtggaggaagggcaaaaccaagtaactattaaacccagagggtatttacagggctgttcaatcttttggcttccctgggccacactggaagaaaaattgtcttgggccatgcataaaatacacaaacactaatgatagctgatgagaaaaaaaaaaggcaagaaaatgtcgtaacattttcagaaagtttacacatttgtgttgggccacattcaaagctgtcctaagccacgtgcggcccgcgggccgtggattggacaagcttgaaaaggaattggttcatcttctagattggtatcgtcagcttcctgagttcccttttctaaaatgggttgtaagaatgactactttaagaacagtatgtttaatttttttttttttgagaaagggtctcattctgtcacccagactggagtgcagtggcatgatctcagctcatcgcaacctccacctcctgggttcaagtaattctcccacctcagcctcctgagaagctgggattacaggcacacgccaccatgcccggctaatttttctattttttggtagagatggaatttcaccatgttggccagactactcttgaactcctgacctcaggtgatctgcccaccttggcctcccaaagtgctgggattacaggcgtgatccactctgcccaccgatatgcttaatttttaaatgccacagaaagaaagagcatgtttgggctggtgcagggcccgcagctcactcactattaaacacttgctgatgagtgtatgggacccagatgcacaggaagtttttcctgaggaaatggccagcctggtggactaggtaaacaccactacaaggtctgtttatcctgaaaaggggactgcccagccctccctataaaatgccaagtggagcaccctagataaagcagctgatgtgcttcatatgcaagccatgtgggattggcttaatgatgaccgggatattcaccagctgaatatgcccattacccaatgtattagtccgttttcatgctgctgataaagacatacccgagattgggcaatttacaaaagaaagaggggtaattagacttacagttccacgtggtgggggaagcctcacgatcatggtggagggcagggaggaacaagtcacatcttacatggatggtggcaggcaaagaaagagagccaagcgaaaggagtttctccttgtaaaaccatcagatctcgtgagactcattcactaccacaagaataatatggaggaaactgccaccagaattcaattatctcccaccaggtccctcccacaacaatgggaattatgggagatacaattcaagatgagctttgggtgtggacacagtcaaactatatcaccgaggtcatagtgtgaaaggaaaataaatctcaggaccccaaaatcactaagccaagggaaaagtcaagctgggaactgtgtcaggcaagcctgcctcccatttgattcttaaataagacagctacaaagataagaagctacatacccccctcacaatttgtgcttaaggaaattccttgtggacaaaggacagacggaactcaaagtcatccttccaaggctcccctgagacaaatgcttatctgataacttcctctgcctcattgcttatgtaaaagtacagattcacggagccagcctaaattgtgtattcagtggaaagctgatcaaggactcaaaagaatgtaaccttttgtctcgtgtctacttctaatctgaaagctcccacttcaagttgtcctgaattactgaactgagcccatgtatgtcttacacatattgattgatgtctcatgtctccctaaaatatataaaagcaagctgtgccctgaacaccttgggcacatgtcgtcaggacttcctgaggctgtgtcacaggtgcacgttctcaaccttggtaaaataaactttctaaattgactgagacctgtctcagatattttgggttcgcaatagattctcagtgtattaatgatgttaggtgaagaactgtgaagctcataaatttggaaaggaaaggtttatttctataaatgttgtggttcaagggtccccttctacaagagcaccccaggtgacattactcttgcagaatcaaacaatggtttgagaaaccttatcaaatttgcagttgtagctttccctcatgggtcttacagatgctaccaaaagactagggtgtcaacgagaagagacaaactgtaaatttttttaagaggtttattctgagccaaatatgagtgaccatggccgcccgtgacgcagacttcaggagatcctgagaacatgcgcccaatgtggtctgcgtacagcttggttttctacattttagggagacatgagatatcgatcaatacatgtaagacgtacattgtttccattcaaaaaaggtgagataactcaaagtgggggattccagctcatggatggacaagacacagaaggttgcattcttttcggtctttgatcagaatacacaatttacatgtgacggaggttggggggtgggggtggtgggtagaggaatagtgactgatgcctgttcagtgaatctgcaagtttgcgtaaacaatagggcaggggaatctatcagatatgcatttgtctcaggtgagcagagagggctgactttcacttctgtctctcctttgacccacacctgtgaagataagccaaggtgaaattgaacagaactgttttagggtaaagatcttgaggtccacaaaaaatttctttgtgggcaaattatgaaagaggtatgtagctttttgttttgttttgtttgtttgtttgtttgtttttgtctccatagctgtcttatttaggagaaaatgggaggcaggtttttctgatgcagttcccagcttgccttttccccttggcttggggattttggtttcctttcactaattaacaaacaaaattaataaattaacaaacaaaaacagggaagggaaaagtgagtcaaagggctcatgccagaagggtggaaatctttagataattattttgttattattattaatttttctttttttgagatggagtttcgctcttgttgcccaggctgacatgcaatggtgccatcttggctcactgcaaccccacctcccaggttcaagtgattctcctgcctcaacctcctgagtagctgggattacaggcacctgccaccacgcccagctaatttttttgtatttttagtagagacgaagtttcacaatgttgggcaggctggaatctttagataattgttaagaaataaaagaaaaggaaaattgatggagttaaaacaaaagactttacaacatgatcaaaggttgggtgggccacagggagccccaactggtcccccaacatgaaggggccccatgccagttttcttcatttgcctcagattggagaagtttaagaaaaattgaggctgggcatggtggctcaagcctgtaatcccagaactttgggaggccaaggcaggcggatcatctgaggtcaggagttcgagaccaggctggccaacatggtgaaaccccgtctctactaaaaatacagaaaaatttgctgggcgtcgtggcacgcacctgtaatcccagctactcaggaggctgaggcaggagaatcgcttgaacccaggaggcagaggttgcagtgagcagagatcatgccattgcactccagcctgggcaacaagagcgaaactctgtctcaaaaaaaaaaaaaaaaagttttagagcaggaatgaaaagaaggaaagtacacttggaagatggccaagtagctgacctaagagatcaagtgtatggttgacctttagacttggggttttataggttggcatgcttctggagtcttgtgtcccttctccgctgagtcttcccttggggttgggctgtccacatgcacagtggcctgccagcacttgggaggggagcatgcgcagtgtgtttactggagttggacgcatgctcacttgaggcgttcttcccttaccagctgaatgttcctagaaggttatagaccagttaaactccaccgttttgcttctcagtgtgcatgcttgagcccactcactcacctcctgagatcgtattgggaaactgctgaccaccagttttaggtgttttctatttactgggagacggcctttccctggtgctgactgtgaccaattattattttagagagacagtttaataaccgcctgatgctcgcctgacattcctggtggggctggggagagcctttcctgccttgctcatgcctgactagctacctactgtaacaataactgaactctttctaccgatttccagtgagaaaatctatgcatctatctatgacctgcaagcccccactttgaagtgtgtcacctttcctggctgaaccaatgtccatcttacatgtattgaggggtgtcttatgtctccctaaaatgcataaagccaatctgtaactcaacaaccctgagcacatgttctcaggatctcctgagggctgtgctatgggccagtagtcactcatatttggctcagaataaatatcttagaatagtttacagagtttgacccttttcatcagcagaggcatacactcttgctatgggatgttaaccgaagctaatggaaataatggtgtccaaaagagttccgtgatgaaacgtaaatggttcatgtaggacctgctacctggggaatgcaaagataatatacaaggagggagcttctttttcctcttcagactgactctgtaactgtgagaagatttttgccttccaaagttattagtgtgttcatttttatctcttaggaaaaaagtggcaaagttggagatggtgtacactttcctttattgcttgactgaggttaaaaatttggccaggcatggtggctcactcctgtaatcatagcattttgagagcccaaggccaaggatagcttgagccaagaagttcaagaccagcctgggcagcatagcgagaccttgtctctacaaaaaataaaaaaattagctgggtgtggtggtgaacacctgtaatcacatctacttggggggctgaggtgggaggattgcttgagctcaggagctggaggttgcagtgagccaagattataccactgcactccagcctgggcaaccaagcgagatgctgtctcaaaacaacaacaacaacaaaaagaacaacaaaaaacaaaaaaaaacttgtattctattgtctcccatcagattatttttaactaattttattttaatcacttactgttgagtcacctctgagattttctattccagtggcgtccttataaaatgaagcttccttgtcaactgcacttgttataacaccgagcttctgctaagaaaaagcaaatgcataactctgtataacctatctcccatgacagggtctatgcctcgctgtatttaagcattcattttagttttcagcaatgtagtactttcacctatattttgtcaaattcaaacacttgcaatacttcatttattttttctgcatgtccttcatattttggctttgctagtccactttggccaaaaagctttgattctttaagtataggcctaaatatcctatcttaagcatgggtgtaattttcttctattaccaacagaggttcttttatagtttttgaaatcactgattaaaaagaaacagctcaaattatattctactgtaaaaatgatacattcagcctgggcacggtcagtcacatctgtaatcacaatacgttgggaggctgaggcaggaggatcacttgagtccaggagttgaggctgcagtgagctgtgatcacaccactgcactctagtgtgggtgacagtgagaccctgtctcaaaaaaaaaaaaaaaaagatacattcaaagaagtcaaaataaaacagtataaaacctatctccctgattgcagctacctttttttatgcatacgcctgcaatccttttacacctatcacacactaaaaatgttttacagttattgttattgcacacagaaggcatctaggaatgttttaaagaacctgtctctctgaagttcatcctgcttatctaacttgtctatcaaggaaattattttcttgattattattgctgagaaagactgggtgaggttgctaccccagaattagcagatgcaaatcaggaggaagtgaacaggctgcaaattagcaagttctggcatggggtgaggcaatggcagaaaatcggtttcctgggaaccatgcccaggaactagcctgacattgtgagaaagctcccaacattcataatgagttgcatattaaattccagggaagggcactgtaggtaagatggaccacatttggaaatacactttttcagacgttttatttagggagaatttctgacatgtcctccgataatttgaacttccttgatttgcagttgtacattgagagatcatttcttggtcaaaataaatgttcagcaggtgtgaatgctgtatccacaacttttttttttttttttttttgagacagtctcactctgttgcccggggtgaagtacagtggtgtgatctcagctcactgcaaactctgcctcccaaattcaagcaattctagtgcctcagcctcccgagtagctgggattacaggcatgtgccaccatgcctggctaattacaacttaatttttaaatttgggcagatttacaaaactatcaagctattaccctgcagcatccttagccctaagcttgtcactacttgtaatgtatttttattttatttatttattttttgagacagagtttcactcttgtcgcccaggctggggtgcagtggcatgattgcggctcactgcaacctccacctcctgagttcaagcgattctcttgcctcagccttccggaccacaggtgcatgccaccacgcctgggtaattttttttttttttttttttgaggtggagtttcgttcttgtcattcaggctagagtgcaatggtgtgatcttggtttactgcaacctccacctcccaggttcaagcgattttcctgcctcagcctcccaagtagctgggattacaggtgcccaccaccacacccggctaatttttgtatttttagtagagacagggtttcaccatgttggccaggctggtcttgaactcctgacctcaggtgatccacctgcctcggccttccaaagtgctgggattacaggcatgagccactgcacccagcctacctactggactttttttcggagacacactgtagtttctcaagaaagaatgcctgttcctggtcccagctgcacactcactttacagtgtgtgctgtacttggtcaagtgtattgatattgaaacacaagccagactggatggaccttggtcataaatcatggggcagctctccttcactgtcagataaaatccaaattctctattactacctccaaggtcccagcattgacgatctgttcttttcttcctgaagggacatcacccccggttctcagggtgtctcctcacaggcttcttacaaatgcctttcctcaggaatgtggctccacaatgacttttttttaattaaaaaatttgcagcctacaatcagcctcctcaattattattattattattaattgttattatcattacttgaaacagggggagagtctcactatgtggtccagactggtttcaaactccttgtctcaaaccatcgtcttgccttgacctcccacagtactgggatgacaggtgtgagcccccgcacctaagtgtcctcttaaaacccatgaagtcttttagggctgtctacttttctctatggaattcaaatcgctaagcattcatgaaagtttagataaggtggaaataaatccaacctttaggatggatgcatgaaactgctctcttttttttttttttggtagagttttgctgttgttgcccaggctggagtgcaacggcacgatctcggctcactgcaatctccgcctcccaggttcaagcgattctcctgcctcagcctcccgagtagctaggattacaggcatgtgccactacgcctggctaatattttttgtatttagtagagacagggtttcaccatattggtgggctggtcttgaactcctgacctcaggcgatctacccacttcagcctcccaaaagtgctgggattacaggcatgagccaccacatccagccaaaactgcacttaaaatccaatctttggccgggcgcagtgactcatgcctgtaatcccagcactttgggaggccaagacgggcagatcacctgaggtcaggagttcgagaccagcctgaacaacatggagaaaccccgtctctactaaaaatacataattagccgagcatggtggcacatgcctgtaatcccagctactcggaaggctgaggcaagagtatcacttgaacctgggaggcggaggttgcagtgagcccagatcgcgccactgcactccagcctgggcaacaagagcaaaactccatttcaaaaaaaaaaaaaaaaaaaaaaatctaatattgtccccaattcctacttttgggagtaaactatgcctatttcaaactattgctggacaagattgcctggtttctgcttccccttatccctcttgttcaagtcaaccagtcaggaaatataaagaatgatcaaggaaacctccaagttaacacagaaatacgtatatatggtgaatgctgtctgcagacagcttatggccccatggtactagccgtcatagcacatggcaaagttgtcctattgactctgctgtcagcccctgcgtggaagaccaaataaaggtgctgggacagaaggatgaaaaggaatcctaggataaatatctcatcttcatcgtccctgggttggataattctgagggtctgtcgttgaatctcagtgtttctgcacagcactcagcttcaatagcccagtggcaagctgcttcataagtacaacctctactggcttcctgcctttccctgtctctcttcctctttccctgaccaatgctccctcaattacctccctaataacctacttggatttaaggtttgaaaaagaaatgcggcatcattctttttgtcttaaatttttaattaaaaaaaatttttttcgagatgggatcttgctctgttgcccgggctgtagaacagtggtggaattacgatacggctcattgcagcctcaaaccctttagctgaagcaatcctcccacctcagcctcctgagtaactgggaccacaggtgtgtgccaccgtgcctggataatttttgtaaaatattttttgtagagacagggtctcactagttgcccaggctggtctcaaactcccaggctcaatcaatctgcctgtctcaacctctcaaggtgttgggattacaggcgtgagccactgcgccgggtcgcaccatcattcctattttttttttttttttttggaaatgaagttccctctgtcacccaggctggagcacagtggcgctatctcggctcactgcaacctctgcctcccgggttcaagtgattctcctgtctcagcctcctgagtagttgggattacagtcatgtgccaccacacctggctaatttttatatttttagtagagacggcgtttcgccctgttggccaggctggtctcgaactcctgggctcaagccatctgcttgcctcaactcccaaagtggtgagattccaggcatgagccaccactcctggacgaagcatcattcttaatttcaatgtctagtctagacatttaaaagaattgaacatattggatcgtatcaaaacaacatcttgttgaagagaatgaccctctccacccaacctgaaacagatggaggcagtgctgactttatctcaatcttaaacaaaatctgtttcactcaattttcttgtagacaggccgactgctttattagaaaacaggagaacattgacctttttctatgattctcttccgatcaccctaggtagaattcctttcactttctaacctgtgtctgtttcaacccaggatacattaagcttgttgtctgtgacactttattgaactttttaatagccacgactgacactgatcctctctgctgagagaggagctattctgattccattcattgtgactccaaagtctaccctggaagtcagatgctcaggtgggattttataaatattccatgaacaaatgaacttcggctttggggtaaaagagtcggttgcccatcatttgatagatccctggatattttttcataaaaaacaccctagcaggttgcttattgcaaaatgacatgtgtcatatcttctctggagctgaatattgttaagcaaaatttatattaatgagaagcaaaaaaaagtttgtttgttttgctttgcttcagcaagaattatctgttgcatcagaaatgcagggagcacttttgctctttattagcgtttttttccccagaaactctgacattactaggacacttggtcatctgtgatctgcttaaaagctctcttcagctcctggaagagtaggtggttctgattctctttcggtgagatggtttatggagccctcttcatcccataattctgaagagtaacaggcagaacgtcttattagggggcagctgaaatcgtctagggaatgtggctagggagtgtcgtcatctttacatcaaaggctatgcacagataacacgccaatcctgatttcacccatgagaaaagtgaactccaagaatttcaggaatgtagacgtgtcgatgataaacattgcatttattacaatttcactttatttcctagaagaggggacattatatttcctggccagatgctaccctttgaaagaaatgcaaactttgataaaatagacatgctatcaatttccttaggggagctttatcttcactgggtcactatacccagcatgacagtaaagtctgccatgtgtttcttgtcccactggaaaaaaatacatagaaaagctatgtacaaggactgtattaagattcatctatgtctttcagagatggcaggcaagtgccatttctgaacaatttgggtgaagtcagacacatgcaccttaccccgacaaccactcaatggacagcagaacattgcaaatcatgacctgtaataggactgtctttgacttacacagctcaggaaacaacacttggtttggtcaaaggtttgttccttttcatttcgtgttctagtgttttcttttcctgcccttatgacagttgtgtgcaatggcattattgcattaaatagacacgactgattaggtagcatgaaccatagtttagaatttggctaagtgtggctatgttactgtctgttttttctttttctttttttaggagatagggtcttgctgtgttgcccaggctggagtacagtggctattcagacatgtgattccaccactatcagcacgagagttttgacctgctgcatttgtgacttagggtggttcaccaggccttaggcagcctggtggtcttctgctcctgggaggtcaccaagctggtgctgaacgtagtgcagatacttgatcagcctagcgcaccatagcccagaacttctgggccgaagcgatcccccacctcagtctcctgagtagccgggaccacaggcaggctacttgctgtttttgtcaacataaaagggagtcagaaaaggcagaacatatcaagatcagtaaatctaggctgggcatgatggctcacacctataatcacagtgcttcatgaggccaaggcaggaggattctttgaggccaggagttcaaaaccagcctgggcaatatagggagaccttgtctctacaaaaaaatagaaaataaagaaattacccaggtgcagtggtgcatgcctgtagttccagccactccagaggctgagactggaggatctttcgagcttaggaggctgaggctgcagcgagctcttatcacaccagtgcactccaacttgggtgacagaatgagaccctgtctctaaaagaaaaagaaaaaaagagattagtaaattctttagaaaccaagattttaccatgagcagttgcatgaaggtggaaaacctttctgtgattataagtagggattctgaaagaagtcctcaaagtgaatacttattccatggagaaacagaatgaattgagagagtcctggaagctgggaggagaggaatctgtagaaagcagagtcacttaactaattcaccaatgagactgcaaaccgatggtcatggagctgccatgggaatctgaattacagtcacttttattctttgtattttattgtttggattgaaaatgcggccaggcacggtggctcatgcttgtaatcccagcactttgggaggctggggtgggtggatcacctgagatcaggagtttgagaccagcctgaccaacatggtgaaaccccgtctctactaaaaatacaaaaattgggattccattccaagatggccaaatagaaacagctccggtctacagctcccagcgtgatcaacacagaaaacgggtgatttctgcatttccaactgaggtatcttgttcatctaattgggactggttggacagtgggtgcagcccacagagggcaagccgaaacagggcagggcattgcctcacctgggaagtgtcagaggatttccctttcctagccaaggaagctgtgacagactgtacctggaaaactgggacactctcgcccacatactgcacttttccaatggtcttagcaaagagcacaccaggagattatatcctgcacctggctcggcagttcccactcccacagagccttgctcactgctagcacagcagtctgagattgaactgtgaggcagcagcctggctgggggggtgggcatccaacattgctgaggcttgagtaggtaaacaatgtggccagggaagctcgaactgggcagagcccactgcagctcagcaaggcctactgcctctgtagattccacctctgggggcagggtatagctgaacaaaaggcagcagaaacttctgcagacttaaacgtccctgtctgacagctctgaagagagcagtggtgctcccagcatggtgtttgaggtcttagaatggacagactgcctcctcaagtgggtccctgacccccttgtagcctaactgggagacacctcccagtaggggccaactgacaactcatacaggtggtgcccctctgggacaaagcttccagaggaaggatcaggcagcaatatttgctgttctgcaatatttgctgttctgcagcctccactggtgatatccaggcaaacagggtctggagtggacctccagcaaactccaacagacctgcaggtgagggatctgactgtcagaaggaaaactaacaaacagaaaggaatagcatcaacatcaacaaaaaggacatctacaccaaaactccatctgtaggtcaccagcatcaaagacaaaaggtaggtaaaaccacaaagatggagagaaaccagagcagaaaagctgaaaattctaaaaaccagagtgcctcttctcctccaaagggttgcagctcctcacgagcaacggaagaaagctggatggagaatgactttgacgagctgacagaagtaggcttcagaaggtcggtaataacaaacttctccgagctaaaggaaatgttcaaacccatcgcaaggacgctaaaaaccttgaaaaaagattagacgaacagctaactagaataaatagtgtagagaagaccttaaatgacctgacggagctgaaaaccacagcataagagctacgtgatgcatgcccaagcttcaatagccgattcaatcaagtggaagaaagggtatcagtgattgaagatcaaatgaatgaaataaagtgataagagaagtttagagaaaaaagagtaaaaagaaatgaacaaagcctccaagagatatgggactatgtgaaaagaccaaatctacatctgattggtgtacctgaaagtgacagggagaatggaaccaagttggaaaacactcatcaggatattatccaggagaacttccccaacctagcaaggcaggccaacattcaaattcaggaaatatagagaaagccacaaagatactcctcgagaagacacataattgtcagattcaccaaagttgaaatgaaggaaaaaatgttaagggcagccagagagaaaggtcgggttacccacaaagggaagcccatcagactaacagtggatctctcggcagaaactctacaagccagaagagagtgggggccaatgttcaacattcttaaagaaaagaattttcaatccagaatttcatatccagccatactaagcttcacaagtgaaggagaaataaaatcctttacagacaagcaaatgctgagagattttgtcaccaccaggcctgccctacgagagctcctggaggaagcactaaacatggaaaggaacaaccagtaccagccactgcaaaaacatgccaaattgtaaagaccatcgatgctaggaagaaactgcatcaactaacgagcaaaataaccagctaacatcataatgacaggatcaaattcacacctaacaatattaaccttaaatgtaaatgggttaactgccctgattaaaagacacagactggcaaattggatagagtcaagacccaacagtgtgctgtattcaggagacccatctcatgtgcagagacacatgtaggctcaaaataaagggatggaggaagatctaccaagcaaatggaaagcaaaaaaaaagcagaggttacaatcctagtctctgataaaacagactttaaaccaacagagatcaaaagagagaaagaaggccgttacataatggtaaagggatcaattcaacaagaagacctaactatcctaaatatatatgcacccaatacaggagcacccagattcataaagggagtccttagagacctacaaagagacttagacttccacacaataataatgggagactttaacaccccactgtcaatattagacagatcaacgagacagaaggttaacaaggatatccagtacttgaattcagctctgcaccaagtggacctaatagacatctacagaactctccaccccaaatcaacagaatatacattcttctcagcaccacatcacacttattcaaaaattgaccacatagttggaagtaaagcactcctcagcaaatgtaaaagaacagaaatcacaacaaactgtctctcagaccacagtgcaatcaaattagaactcaggattaagaaactcactcaaaactgctcaactacatggaaactgaacaacctgctcctgaatgactactgggtaaataacgaaatgaaggcagaaataaatatgttctttgaaaccaatgagaacaaagacacaacataccagaatctctgggacacatttaaaacagtgtgtagagggaaatttatagcactaaatgcccacagaagaaagcaggaaatatctaaaatcaacaccctaacatcacaatgaaaagaactagagaagcaagagcaaacacattcaaaagctagcagaaggcaagaaataactaagatcagggcagagctgaaggagatagagacacaaaaaacccttcaaaaaaatcaatgaatccaggagttggttttttgaaaagatcaacaaaattgataggccgctaacaacactaataaagaagaaaagagagaagaatcaaatagatgcaataaaaaatgataaaggggatatcaccaccaatcccacagaaatacaaactaccatgagagaatactataaacacctctatgcaaatgaactagaaaatctagaagaaatggataaatttctggacacatacaccctcccaagactaaaccaggaagaaattgaacctctgaatagaccaataacaggctctgaaattgaggcaataattaatagcctaccaaccaaaaaaagtccaggaccagatggattcacagccaaattctaccagaggtacaaagaggagctggtaccattacttctgaaactattccaatcaatagaaaaagagggaatcctccctaactcattttatgaggccaacatcatcctgataccaaagcctggcagagacacaacaaaaaaagagaattttagatcaatatccctgatgaacatcagtgcaaaaatcctcaataaaatactggcaaaccaaatccagcagcacatcgaaaagcttatccatcatggtcaagttggcttcatccctgggatgcaaggctggttcaacatatgcaaatcagtaaacataatccatcacataaacagaaccatcaacaaaaaccacatgattatctcaatagatgcagaaaaggcctttgataaaattcagcagcccttcatgctaaaaactctcaataaactaggtattgatgggacgtatctcaaaataataagagctatttatgacaaactcacagccaatatcatactgaatgggcaaaaactggaagcattccctttgaaaactggcacaagacagggatgctctctttcaccactcctattcaacatagtgttggaagttctggtcagggcaatcaggcaagagaaagaaagaaagggttttcaattaggaaaagaggaagtcgaattgtccctgtttgcagatgacatgattgtatatttagaaaaccccatcgtctcagcccaaaatctccttaagctgataagcaacttcagcaaagtctcaggatacaaaatcaatgtgcaaaaatcacaagcattcctgtacaccaataacagacaaacagacagccaaatcatgagtgaactcccattcacaattgctacaaagagaataaaatacctaggaatccaacttacaagggatgtgaaggacctcttcaaggagaactacaaaccactgctcaacgaaataaaatgacacaaacaaatggaagaacattccatgctcatggataggaagaatcaatattgtgaaaatggccatactgcccaaggtaatttatagattcaatgtcatctccatcaagctaccaatgactttcttcacagaattgggaaaaacgactttaaagttcatatggaaccaaaaaagagcccagattgccaggtcaatcctaagcaaaaagaacaaagccggaggcaccatgctacctgacttcaaactatactacaaggctacagtaaccaaaacagcatggtactcataccaaaacagagatatagaccaatggaacagaacagaggcctcagaaataacaccatacatctaccaccatctgatctttgacaaacctgacaaaaaccagaaatggggaaaagattccctatttaataaatggtgctgggaaaactggctagtcatatgtagaaagttgaaactggatcccttccttacactttatacaaaattaattcaagatggattaaagacttacatgttagacctaaaccataaaaaccctagaagaaaacctaggcaataccattcaggacataggcatgggcaaggacttcatgactaaaacaacaaaagcaatggcaacaaaagccaaaatagacaaatgggatctaattaaactaaagagcttctgcacagcaaaagaaactaccatcagagtgaacaggcaacctacagaatgggagaaaatttttgcagtgtacccatctgacaaagggctaatatccaaaatctacaaagaacataaacaaatttacaagaaaaaaacaaacaaccccatcaaaaagtgggcaaaggatatgaacagacacttctcaaaagaagacatttatgcagccaaaagacacatgaaaaaatgctcaccatcactggccatcagagaaatgcaaatcaaaaccacactgagataccatctcacaccagttagaatggcgatcattaaaaagtcaggaaacaacagatcctggagaggatgtggagaaataggaacacttttacactgttggcgggagtgtaaactagttcaaccattgtggaagacagtgtggcaattcctcaaggatctagagctagcaataccatttgacccagtaatcccattactgggtatatacccaaagcattataaatcatgctgctatcaagacatatgcacactattcacaatagcaaagacttggaaccaacccaaatgtccatcaatgatagactggattaagaaaacctggcacatagacaccatggaatactatgcagccataaaaaatgataagttaatgtcctttgcagggacatggatgaagctggaaaccatcattctgagcaaactatcacaaggacagaaaaccaaacactgcatgttctcactcataggtggtaattgaacaatgagaacacttggacacagggtgggggacatcacacaccgggcctgttgtggggtggggggttgggggagggatagcattgggagagatacctaatgtaaatgacgggttgatggatgcagcgggccagcatggcacatgtatacctatgtaacgagcctgcatgttgtgcacatgtaccctagaacttaaagtataataaaaataaataaataaataaataaataaataaaataaaatcaggagaaaaaaaattggccagtcatggtggcaggtgcctgtaattccagctactcaggaggccgagacaggaaaatcgtttaagaccaggaggcagagattttagtgagctgaaattgtgctgctgcactccagcttcggcaacagagtgagactctgtctcaaaaaaaaaaaaaaatgcacatgccctttatatgtaaattttcattttagggaataagttcacatcttcttaacatatattattttggtgtttttagacaattccagttcaaaattcctctccaggtacatttacctgaagaaatctgcatctctggtctaatgcaagatctggtttccaggctgggcgcagtgactctcgcctataatcccagcactttgggaggccgagatgggaggattgcttgagcccaggagtttgagaccagcctgggcaacatagtgagattatgtaaaaatacaaaaattatccatggactagtgggtgcctgtagtcccagctattcgggaggctgaagcaggaggatcactcgagcctggaagtcgaggctgcagtgagctgtgatcaccataattttactccagcctgggtaacagagagacaaccagtctcataaacaaaacaaaacaaaatctggtttctagagtttatagaatcatacaacagcatgtttcatggagcgttccatctcacaaggtggtgtttggtttagagagggttatgtatgccctctgatattctcaaatctttatttaaaatgctgggagagttgctatctggctttgcatcagtgtttaatataatagccatccttttggggtgggtgttgacgaacagcacacctgccatcttccaaattataccccacactttgtcttgttgaatattattaagatataaagacagggaagaccttccatttccctcccacgtccccaccacctttagttgggagcacagatgtccctgaggcactgctatagaccatgaggtcaccgcaacacaagggacatcaaatgggattgctctggctcaaaacagccagtcttaattctggtgcgatgaatggctttggtggtcgtcccagataagaacattcagcgtcagcaagaaaggctgtaggtatttggctgaatgtaatgttttgttgttgatgtgctgttgtttttcttttcctgggtgtgtagtaggagttgcaaatgcgggctgcagattagcaacgggaaccatctgggtgagcctagcagggaccagccctcccatgggagagagaggtgacacggagcagctgatgctttcgtaatgattcgaggcagctgccaaaagaggcagagcctttgcagaacagcctgtctgttctgctcctagacattagagagataatacggctgataggtgagttggggaaggcttgtttggacacattttctcagccttttttttttttttttaacctctggtagaaacgggcatagttgaaagatccattgacctattgtattctgaaactcaatggatcatcagcttaggcactgagaaatggattccaaaccaattttagtgtgagcaagtttctctcctttctgttactctcataccctttcttctttcttccctccctccctcccttcctttttctttcttaaccaagaacgtgtgtgtgtgtgtgtgtgagtgtgcgtgcgtgtgtgtctgtgtagtgtgtatagtatgtgtccagagtatacatgctttggaacaaaatgaatttaaggaggaatgcgtttgtattttgtccttagtgttattttaaggtacaaatatgggtaataacttgcagactacagatgggcttttctttcattgtaatgcatttggctgtcatatcccttagtcctaacccctctgccactgccaactaaatataaccattagtcattcagtggtttctgcattttgcagtcaaaaaagagggagctcattttgattaattgcctctttccttattcaggacacagaagctttctgagtttaaacttttaggcttggcaggacattgagacaatgctcttgggccagcatgtttcagggcaggttttgccactgagacaattcatccaagagccccaggacttggggcagcaggagttcttttaaaaatgggccaaaagacgggcagagcacttgaggtcagcagttcaggaccagcctggccaacatgctgaaaccccatctctactaaaaatacaagaattagccgggcgtggtggtgcacgcctgtagtccccactactcaggaggctgaggcaggagaatggcttgaacccgggaggcagaggttgcagtgagctgaggttgcaccactgcactccagcctgggtgacagcgagactccggctcaaaaaaaaaaaaaaggtcaaaagaatgaactcattgaaagttcaggatttgtgcagtagtggccttggaaaatcaatttaaaaatgtcggaattagggatatggctcacaagtctagtgtgaatttcatgctgggaactaatttaattgacacatgaatgatactttttttttttttttttggtcttttaaatcacgtctgtgtcttctgccaaagacaacaagaaggtattccaagctgcacaatgaggcccaggtaggtaaagccatatactgcattgtgagcacattgaatctaatgtataattctgtgtatttgtgaatccagccttataggtagaggcatttaatatcatctgcctttttttcttttttctttttcttttcttgtaacctactatgagtcaacatgctgtctttatatggctggccataagatgtctaagttcattctctcgacttagtaagtgtgtaagttttttaaaaaggtaggagttaggcaattgatagagatgtaaactgtaaatttccaacagatacatatgagtttatgtttatttttatttattttagagacagggtttcacagggttttgctctgtcacccagggtagacgacagtggtgcagtcatagctcactgcaacctccaactcctgggctcaagagatcctccagcctcagcctccagagtagctgggacctcaggtgcttatcgccacgcccagctaattttttatttttattttttgtagagacaggttctcattttgttgcccaggttggtcttgaactcctgggctcaaggaatccccccgcctcagcctctcaaagtgctgggattacaggtgtgagccaccattgtgcccagccgtatacatgattttaaagtgttgtaaaaacaggaggtgaaaaaattcaactaactttgcatagatgaaaagcatttctataacttcggggatttggcccacagtcctgagcatgtagcttttgcctgcaagacattctcaatcttcaaggagatgtttgcatacagcaaaaaaattgtactcttctgtggctgtcattgtttcagagtatttacaaaggactctgagagccaatagggatgaactcctgtttgtattttttctctcagaggagatatttgaagtgggttttgaaacatgtatagacatgagataggaattgaatcaataatccacatgtccaatattcattacctgataactgagtagggatatgctgagaagagcgtcatgtgtttccttaagaaaatatgacctcagctgggactgagcaaaactatgaagtggactcaggtggtcctcagagtccacgtttctttcttttcctcaattcagttctttccccaacttccacttttcctttacttggtaattccttattttattttatttatttatttttttgcttgtttttcttttctccagccaaagctgctattctcacactttttcttcttttgagggtctcgtcctgtagcccaggctagagtgcagtggcgcaatctcagctcactgcaggcttgaactcctgagctcaagcgatcctcccacctcagcctccagagtagctgggactacaggcatgcaccaccacacccagttcatttttacatttttttgtagggatggggtctcactatgttacccaggctggtgacgaactgattctcctgcctcagccccccaaagagctgggattacaggtgtgagccactgcaacctgactttttaaaaatttggagtaatgataaattgcatgtatttattctttttatattatgaatattttatttttatttattttttctttctttttaaattcatttttctttttatttttttcctttttaaatttctttttctttttttattgtcccttgagtcaaaaaagctgacatataaacattgcatagatttatggtgtacaacttgatgttttgaaatacgcctgcattttggaatagctcaattatgctaatgcatgttacctcatccacttacctatttgtgatgagaacactttgagtagattttatcagtaattttcaactctaaaatacattcttattaactacagtcagcacaagtacaatagattctttgaacttatttctcctgtcaaattgaaattttgtatccttcgaccaacatctccccaacccctccactggccccccagctcccagcaggcatcattctaccctttccttctatgagatcaactttttgagatttcacatagaagtgagatcatgtggtattggtgtttctgtgccaggcttattttccttagcataatgacctccaggttcatccacgttgttgtaaatgacagaatttcattcttttttaacgctgaataatattccacggtgtatatgtaccgcattttctttatccattcatgcaatgatggacactgaggttgatttcacagtttggccattgtgaatagtactgtaaggatcacacacacccacatgcccttaaattagaataaaaattctaattttagaatgaagttaaggttaaatcccttacctgtagagactcatttaagtcccttaaatgaggttaagtccctggaagagggagttaacctcaggagtcttatcgtctccgtcctctgcaatgatttgcccctgagtacgtgttttcagacttccctcctggaagggcatctactttagccttttaaaaaaaattcaatagtttttggggagcaggtgatgtttgattacatggataagttctttagtggtgatttgtgagattttgatgcacccatcccctgagcagtgtacactgcacacaatgtgcggtctttgatccctcactcccctcccaccctttccctgagtccccaaagtccattgcgtcattcttatgcctttgcagcctcatagcttagctcccacttatgagtgagaacatacaatgtttggttttccattcctgagttacttcacttagaataattgtctccaactccatccaggttgctgcaaatgacattattttgttcctttttatggctgagtagtattccatggtgtgtgtgtgtgtgtgtgtgtgtgtgtgtgtgtatgaatatgaaaatttgatatggatagatagatacctgcagatctatacagataaagaagatgtgttatatataggtatctacagatctatagatatcaagagtgtctcgctccaagcaccaagcactgctgctgaatggcagcagaagtgcccaaagaaatgcgctcttggcttctcactttgtatacaatctatagctatctatctctatatatcacattttctttatccactcattgattgatgggtatttgggctggttccacatttttgcaactgcaaattgtgctgctgtaaacatgcgtgtgcaagtgtcttttgttgttgttgttgttgttgttgttgtttttgatggaacctcggtccgtcacccaggctggagtgcagtggcacaatcttggctcactgcaacctccgcctcccgggttcaagtgattctcctgcctcagcccccctagcagctgggattacaggagtgtgccactacactcggctaatttttgtacttttagtagacacagagtttcaccatgttggccaggctggtctcgagctcctgacctcaggtgatccacctgcctcggcctcccaaagtgctgagattacaggtgtgagccaccacacccggccgcaagtgtcttttatatataatgccttcttttcctctgggtagatacccaggagtgggattgctggatcaaatagtagatctacttttagttctttaaggaatctccatactgttttccacagcgcttgtacattcccactaacagtataaaaggattcccttttcactgcatccatgttaacatctgttgttttagcctttattttatgcaaagtgagaagccaataacgcattacgttgggcacttccgctaccattcagcagcagtgctcggtgcttggagagagacactcttgagcttcaggagatgcctgggagatccacgtgatctccaaagacccctgttgtgttgtgttgggaggtggatcctgaatccacccagagaagcctgataccaataaaatccctgcttgctttccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggtaaggcggtttcatggccagtcatacgttcgtcagtcgttcaggttcagcaggctggctgtacggctgcatctatgtgcaaaaccaaatgtatttgttgggacttttttttaagttactttaaactttttgatagttttaaattatttagattatgtaatagttttacaattacatttttaataattttaatttgaatctctttcagtttttaaacttaagaaataataattgtccatcttcacagggtacacagtgaggtttggatacatacaaagtatagtgatcagatcagggtaatcagcacatccagtgcctctagcattaaccaggatggtcatagtaaaagcatggctatctggacccgagtcctggctctgcatttactagctctgaagtcttagagaagtcgctgaacctctctgtgcctgttttcttatttgtcgaatgcagagaaggctttatatccctgagtttatgtgtgtaaagaacttagaatagtacctaacacacaactaccctctatcatacagcctattatgaagcatgatgattgtatgtacatgtacatatacagatatgaacatataaatgtcattatataaatatatgtgatatattcatatatgaatatattctataatatataaagtatatatcatacatttattatattacatatccatatattatgaatatatgaacatacattcaatgtataaacatatatgaatatatttataatatatgaatatataatattactaatatatatgaatatgttattcatatatacatgaacatatacatatttctatgtctatgaatatatattcacttttatataaatgtatttttaaaaattaaatataaatatatttaaataaatatataaacatatatttatatattttataaaagtacatttaaataaatatatgtaaatatatattcattttatataaataaatatttatataaaatgaatatatcttcatacatattgataatatataaaagtatatattatcaatatatattgataatatataaatatatatttatatatataatatataatattcataataggctgtatgatagagggtagttgtgtgttaggtactattctaagttctttacacacataaactcagggatataaaggcttctctgcatttgacaaataagaaaacaggcacagagaggttcagcgacttctccaagacttcagagctagtaaatgcagagccaggactcgggtccagatagccatgcttttactatgaccatcctggttaatgctagaggcactggatgtgctgattaccctgatctgatcactatactatatattaataaataaatatatattatttattaatatatatttaattatacatatataaatattttaatataaataaatataatataaatatttataaatatatttataaataaaattatatataattataaatatataattaaatatataattaataaatatatattataaatatagatttataatatataaatatatattaataaatatgtatgaatttatgaatatatattcaattatatatattcataaatatataaatgtgaatatgtatattcagcagaattcattctgtttcctaatttggtgagccaatagattctttaagatggtgagcttgtatttttaacaatgggcattctgaaagaagaaaaacagatatgaaacaaactcagtgctttgtggtggataatagaagctatctgtattagccattcttatactgagcttaggagtacatcgttatcagacgtacatcatacacttttaagatcattgcgttgtatgactaatagatgctgaaggtagtcatcacagttttcgacaacggagctaggagtcatgaaaaagtagtcgccaaaaattaaccattgcttatgagaaaagaagagaggactcaccgaaaagcgcagaaacatggtgtccataaatggcagatatttacagagagtatgttagcgtggggtatcggtgttttgctgaaaatactagcaatttgagaagtgagattataatgtgaaatctaaaaccaggcacatgtgccccaggaatgcagtttacaatttttttctttgcaaaataaataatgttttaaaagttggtaggtgacttccatatctgaaaaaaaaatcagatgcacaccttggtaaagctggaacttctccttgcaccagttacctgtcataatttctctcatgaataaatgtagaactcattatattttattttcatccaagaggagactgattctttttccagaagtctctccagcctccagaaatctcttgttaaattattttttaattgacgaattatagttctgtgtatttctggtgtacatcatgatgttttgattcatggatccattgtggaatagctaaatcaagctaattaacatgcacaaccacacatacttattatttatatgtggtgaaaatggtgaaaattatagcaatttcaagaatagaatacattgttattaactatagtcaccacaatctgcaacagatctcttaaatttattcctctatgtgaggaataaatcaaatagaggatttattcacgtttggctccgtgaaatgttgtatcctttaacctacctgttctcgaccctcaccccagcgcctgatacccaccattctactgtctacttctgagtttgctattttagattccacacataagtgagatcatgcggtatttgtctctctgtgcttggcttatttcatttaatctaatacccttccagttcatctgtgttgtcgaaaatggtgggatttccttcttttgaatatttaatcatatgacagttttgcaacctatgcagactgcagggaaatgtatctatcaaaccagtgagtgggtgggtctgtgagtagttaggcataagtaaggtctgtaagcaattagcctcgatgaatcagaccccaatcccttaagcattttattttgtaaggctgaagtacagtgaatggacaccatatagtggcacccaggtatatgaaccctgcagaacaacagctgcctggaatctcagtcatacttcaccttgacacgggcaaaaaagaaaaatgaactccgtgtgcagttacctgctctgggtacctggaaatcataataaacagagatgttgtttatcttcagatctctctgtctctctctctgtctctctctctcctctttctgtctctacatctctttctatgcctatgcgtgtctctgtcacccctctctgtctgcttgtctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctctgattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctctgtatctctctctgtgtctctttctctcttttcatctctccctgtttgtctctctctgtttttctttctgtctccctccatctgtctctttttccacctctctttctgtttctctctgtctccctccctctgtttatctctctttccatttctttctgtctctctcttaatctctgcatgtctctttccatctctctctttctgtttctctctctctgtctttctctctctctcttgtcttctctctgtccctctctgtctttctctgtctccctctttctgtctttctctctccttttttctgtttgtctctctctttccatctctctctgtttctctctgtgtgtcttaccctttgtctctttctctgtctcttttcatctctctctttctgtttttctctttctatccttttctgttgctctctttctcgtttgtctctctctctctttcatcctttctttctgtctgtctctctctctgcctcgctttctgggtctctccctctctccctgtctgtctctcctctctctttccacctgtgcctttctgtttgtccttctctgtcttcctctcgctcttcctctctgcttcccccgccccccaccttttccttctctccaatacaccttccctctcccccttcaggacgcctcacatcgaccgccttgccagggaaggcgtgcgactgactcagcacatctctgccgcctccctctgcagcccaagccggtccgcgttcttgacgggaagataccccatccgatcaggtgcgcaaactggcgggctctgctgggctctgccctcatgttaggatgtgaggaaacaaaaatgtggcttgaccacgttaacaagtaaaaaagggctgggcacgatggctcacgcctgtaatcccagaacttcgggaggccaaggtgggaggattgcttgagcccaggagtttcaaaccagcctgggcaacagagcaagaccccatctccacaaaatttttttaaaataagttgagcatggtggcatgtgtctgtggtcccagctacttgggaggctgaagtgggaggatcgcctgagcccgggagtttgaggctgcagtgagtgtgatcacagcattgcactctagcctcgttgatagagcatgtgttagaaagaaaaaaaaagatacaaaggaaagaaaagaaaaagcacacatgtgcataggtgcactggcacacacagctagcactggtcacatcaaaatggctgcgcttctcagagatgcaagatcaccctgtgtgcttcagttgtcttttgatgcaatgagagttttttatctgaattccaagtcacaaggtgtacatttgagtttcccaggtcaacaaagataagctgtcttggaatgaagtaattaatacaacatgtgtttacacattcagtctgtcaccaaaaaatatctttttttttctttcaaaccacaaagtcatggccgggcatggtggctcatgcctgtaatcccagcactttgggaggccaaggcaggtggatcacttgaggtcaggagttcgagcccagcctggccaacacggtgaaagctcatctctactaaaaatacaaaaattagccggacatgggggcatgcacctgtagtcccagctactcaggaggctgaggcaggagaatcgcttgaacccgggaggcagaggttgcagtgagccaagattgtgccactgcattccagcctgggtgacagagcgagactctgtctcaaaacaaacaaacagcaacaacaaccaaaaacccacaaagtcataaaccaagaaatagctatcagatttttggacaactttcatcacagcattttacccatggagacagtagtattatccccttgctcaatttatatcaattttattttatttattattattattattattattattatttttgaaatggagtctcgctctgttacccaggctggagttcagtggtgcaatctcggctcattgcaacctctgcctcctgggttcaagtgattctactgcctcagcctcctgggtaactgggattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatggagtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaagccatcttccctctttggcctccaaaagttctgggattacaggcatgagcaactgcacccaacctggtgactttttttgtttgtttggttttttgcttttgagatagggtctccctttgttgcccaggctgaagtgcagtgtcacaatctcagctcatcacagcctcaaactccagggctcaagcgattctccctcctcagcctcctgagtagctgagattacaggtacccgccaccatgcccagctaatttttgtatttttggtagagatggggtctcaccatgttaaccaggctggtcttgaattcctgagctcaagtgatcggcccacctcggcctcccaaagtgctgggattttaggcatgagccaccgtgcctggccaaaagtagctatttttaaatgtgctattcagtagcatgtagctctttcccaatattgtacaaccatcacctctatcgaattctagaacatttccatcacccacaaaggagatcttgtccccatgaagcaatcactccccattcccccttctcgcagcccccggtcaccaagaatccactttccgtctctacaaacatgtctgtcctggacatttcacataaaaggaatcatacagtatgtgacagtctgtgactggcgtctgtcaccaagcataatgttttatggtagcctgggtcagagtttcatttatttttatgttgaatactattccctcgcatggattcactacagtttctccatccattcatcaattgatgggcagtcaagatgtttctattgtttagtgattgtgaggaatacaactatgaacatacatgtacaagtttttctttgaataccagttttcaatccttttgggttcctcaggaacctcaattcttttgacattccccaggagtgaaattgttgggttgcatggttctattttttttttttttttttttcagatggagtttcactcttgttgcccaggctggagtgcaatggcgcaatctcggctcactgcaacctctgcccctgggttcaagcgattctcctgcctcagcctcctgagtagctgggattacaggcatgtaccaccacgcccagctgattttgtatttttagtagagacggggtttccccatattggtcaggctggtctcgaactcctgacttcaggtaatccccctgccttgtcctcccaaagtgctgggattacaggtgcgagtcaccacatccagtcatatagttctatttttaaaggtgagggaagtgggcttggggcatggtggctcacacctgtaatcccagcactttgggaagctgaggagggcagatcagttgaggccaggaattcaagaacagcctggccaacatggtgaaaccccatctctactaaaaatacaaaattagctgggcatggtggtacatacctgtaatcccagctactcgggaggctgagacaggagaattgcttgaactcaggaggcagaggttgcagtgagctgagatcatgccactgcactctagcctgggcagcagagtgagatttcatgtcaacaacaacaacaaaaaaaaaaaaaaaaaaaaaagagagagagagaaaaaaaaaaaagaaaaaaaaatggtgagggaagtagtcttcgcttgtgggtacagatgccgcagtttaatgccaaattatgtggattccagatagcggttcttggaggcagaataaaatcgcacgtatcaaccctactgccagtctgctgacactgactttggacgagaagaaagaaaaggtcttttttggctgagtgcagtggctcatgcctgtaatcccagcactttgggaggccaaggcgggcagatcatgaggtccggagatgcagaccatcctggccaacatgatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcactgctgcactccagcctggtgacaaagcgagacttcatctcaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcatcccctcctaaaagccctacctcctaaccattaccttgcagatgaggatttcaatgtgcaaattttgtagtgacaaaaatattccctctgtagcaacacctactcattgtacttttttccacactacatctaggtatggtttctagtggtaatagacgtgtcatccaaaatcttgcagtccccgcaggcctccctcttaatgagacaacacttgcagccttgctaaagaagcaaggatacagcacggggcttataggtaagacacaagaattggtgttagtcattgatcataaggtaatcatgtcctttgttctacccttgatttatgactttcttggaaacgctgtattttacaatgtcttatgtaaaggcgcagtggcccatgcctacaatcccagtactttgggaggccaaggtgggaggatcgctggaaaccaggagtttcagaccagcctgggcaacatagaaagaccccgtctctaaaaatataaaattagctaggcattgtggcatgtgcctatggtcccagctactccagaggctgaggtgggaggattacttgtggcaggacttcttttctttattattatttttaaaacagaggagtctcactgtgtcacccaggctggagcacagtggcacaatctcggctcactgcaacctccatctcctgggttcaagggattcttgtgcctcagcctctcaagtagctgggactacaggcgcgtgccaccacgactggctaatttttgtatttttagtagagatggggtttcatcatgttggccaggctggtcttgaactcctggcctccagtggtctgcctgccttggcctcccaaagtgctgggattatggatgtgagccaccacacctagtctgattcttcacacagctcagtgataggagatgttttaaaatgaatatattacaagaacataaaatttttctggctctgcctgcccgcatagtctctcaccgtgtatcctgtcatctgcctctttatttcactaaaaatggaccacacagattttcttctcactgccaaggatgatagaagtcctcagccacccagtagttggaactccaactactattcctgtttgggaagcctgggtttcagctggtgtgagaataacatgctgttttaaatcccttcaatttttgtaatacatctgctgttgataagagaaggcaatctccgtggggttgcaggacaggaagcctaagccagtagcactgcctctcctctacctatccccacaggcactcagaggttgatggaagcacaggcattcttgatggggccctcaccacatacaggaagctgttaatattcctagtagatacacattatcgcagcctctgagggtttgctgatcatccacatgctagcaggactcacaggcaccctttggtgatcattcaaggtgtggtacgttttactgaataagtcccttacttcgatcagttttaatgagagcccctaggatttgcagtcagccagctattcatccatccatgctggtccatcctccatgatttatctatagctatcatcggtcatctctctctctttctccatccatccatcaacccatatatctctatgcatctatccatccatctacctgtctatctatctacctgtttgtctattgatcaatccatcatctatcatttatctatcatctatgaatctatctacccatcatctatctatcatctataatctattcatccactcattcatctatcatgtatctatctatccatcatctatatctgtctatttatctagccattcattcatctatttagacatctctctatccattcacccatccacccatatatctctatccctgtctatttatctatctgtctactcacccatctatcctttcatccacctacatatacaaatatgctccatctgtcctccatcatttatttgtacgtgtcatatttattacatctatgtctctattgatatatacatacacatatgtatacatagatgcatactccataatttatttttatccatatcttacctgtctattcatccacccacaacacagatctattcatgcatctctctatctaatcacccactcatccaggtatccatctgtccacctacacacacatatatacatgctccatctatcctccatcatttatttgaatctgtcctatcctatcttatctatttatctatctatccatctatccaactactcactctatctctatcatctatttatctatctatccattcatctatcaatccatctatccatcatatctatctatctatctattcatctatcctatctatctatccacccatagatctccatccacctatctactcacctactcagccacccacctatctatccatgcatccacttacacatacatacatgccccatctatccatccatcatttatttgtatctatcatatttatcacatctatctctctattgatatatacatacacatatgtatacatagatgtatacaccataatttatttttatctatcatatcccatctgtctattcatccacccacaacacagatctatttgtgcatctatctaattagctagtcatctatcgatccatccatccacctacacacacatctatacatgctccatctatcctccgtcatttatttgaatctgtcctatcctctcctctcctctatcctatctatctatctatctatctatctatctatctatctatctatctatccatccatccatccatccaaccactcactctatctctatcatctatctgcctatctttctgtctacatattatctatcatctatctttctttctatcatctctatttatctagctagctatatctacatatgcatctgttcatctgtctatctacctatctttctgtctacatattatctatctatatatctacctacctatcatctctagctagctagctagctctatctatgtatacatctattcttccatcaactataacctgccttgtctctgtgatgtatctattcttccatcatctgtaacctgccttgtctctgcggtgtatctattcttccatcatctgtaacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtttttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggtaagcggaataattacaaattcatgtaataatgataatgatctcttttttaaaaggacctagatagatctgtagggtgattgtagtttataataatctattgtacacttctaaatagctaaaagagaataagtcaaatggctctagaataaagaaaagacaaatatttaaggtgatggacaccccaattacactgatttgaaaaaataaatcatttgtaataattctttacaaattatatgaatgtattaaattgtaacgtgtactcttaaactatgcacatctataatgcattaataaaaataataggggatgatggtattaaaaatattgagttaggaaatggaatattgctaaatggtgtaatagggttagataaaaatatgaagtgtattgaagaccagttggactcttcagttggtacctaaagcggtggtaccttgtttgggctcctgttattaaaatcatggcctctctattggctctgaaatttatatgttgtcagaccatggacgcagaccctagtaacttaaactcacaaattgtttacgttaatttacaatgcatcttgtcatcatgttaacttacaacagggaatatgtacatatacaatatgtatatactatactatatatgtatatatataatatattttataatattttttgtctggttccctgatacatatagataaatatatatatatatctggaaatcagatgaaaaaagtaagttttccattgcattatgttcctgttgttaaaaaacaaaaaaaaagctacttggggaaattaaaatcagaaggcttctctttgagcatgtgatacgtaagggctatttcatgaattggatgaggtaaatggtcaaaggtgattgttataaaaactttatgcatccagaacacaatgactggaaattttcaagggtatctatcctcttgttgttggaccttctttctttaaaaaaagcctgtaaacacattttttcatttgctttttccatattgattgaggcttaatctttaccaatagccattctaggatctggattttcaggatgtaaggtgtcttgtgtactctggtacatagctttgtcctcactctgtagcccaagtgaaggtgataaatatgtagtttggggctggcagcggtggctcagcactctgggaggccgaggagggtggatcatctgagaccagcctgaccaacatagtgaaacgccatctctactaaaaatacatattagctgggaggctgaggcaggagaatcgcttgaatccgggtggcggaggttgcagtgagctgagatcacgccattgcactccagcctgagcaacagagggagactctgtcttaaaaaaaaaaatgttgtctgggagtaataaagccatacttgctctgtagatgcaactgaatgcttggtgtcacttagagcaaatctttctgttccctggtacctttccaaatgtgcagagttctatgaatttttacagacagagcatcaatatgtgcaaattagcaccaaccactctgaaagtatatgataagcaatcctattctcttctgtctgccagttcgtcttcaaacattcccacacagttctccttaggaatttacatgagtacttgaagaacagatcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaagttctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaatgaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggatttagtgcccatcctaattccaggatgagctcatcttcagatccttaattaattacctctgcaaaggtcttgatatccaaataaggtctcattccaggttctgggctttaaaatatatggacttatatttctgggggctactattcaaactactacaattgtatccagtttcttctggaggctctaggggaggatctcttctgcctcctctagctcctggtggctccagatgccccttggctggtggttgcattactccatttccacatggcctcttcttctgtgcttgtgtctcctcttctcctatagggacaacattattggattggggactcatcctaatccagaatgatcacatcttaagtaattaaatctccagaggccccatttccaaataaggtcccattctgaggtttcaagtgaacgtgaattttgaggggtcactgttcaagacaccatgacataagtcttgtttttaaaattcattttttttatttctttatattttgatatctcaccagagcagaaatttcccaacgaatggcatttgtgctgtgtgttttcctgggtagctgaggacttatcattcatgcagatggattatcaaaattaacagcgggtcagcctagttccctgtatcctcatgtgagaacctacagggtgcaaatggcttgccaaggcattcctgtttgtactggcttatggctcgtgaaactcttgatctggctaagaaatgacttccataccactgtctcttgatgtatctcagggtgtgaccctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaaggagttctgggctggattttttaggggaatcatggagggtcttggggtcactgatgggttggggtaagagggaatggaatcatcagaatatggaaatggtatgctttggtaagtcagcttctcatagggtccttcagagaagcagacatcagcagtttccctggtatgcacaacctgaaagattattgcaaatggaaaacttaacatttcatgatgttatgttatcatcctgtaacaggatctgtgcgattctagaacaaataggtaccaaacaagtaggaatacatagatgagagggcaagctgacctcaggatcaaagctgagtatgctgcaagcttagttcattttgtttctcccgctcccttcctctctgattgattttatgaagtttatagagatggtttcagtagcattaccaaaggggttagggagcagttgaggtgctgcaggatcatggagtccattctatgcaggatggggcccttgggtggacccactctatcttctgcagcttggagaagaaggaagcaggtcatgtctatgagaagccaaaacaatagttttcacattcatagatattgaaaactcacaagtagtttcattgatgtcttctcaggcacagtaaggaaactttccttctctttttctcctttcttcacgtgcacacacctctccccaccacggacgatttcactggcaccagcaagcatggcttgtatggggataatgtggaagagatggactccatggtgggtaagtcacaggacttaagtggacagaaactaacgtgttctgataggacaggacacctgaaaactgctcttggtcaacctgtagagtgaagagaattatgcctatgggacagagtggtctgagacattaatgaggtaatagttgctagcaattgagaaagtcagcaaaaaaactatatgcatttcctctcctttctttgcatgctgtccacttatcaacttgggtctttgtctacttgactgcgtctccagtgctggccagataacaaatcaaatcttcttttcaaaaatttcaactcttgttttagattcagggagtacatgtgcaggttttttacctgggtgtattacgtgatgctgaggtttaggatatgatcaaacccttcacccggacactaagcatagcacgcaatagttagttttcaacccttcccccactccttccttcacccctctagtagtccccagtatctattgtactgatctgtgtgtccacatatacttgatgttatgctcccacttattttgtttcatttttaaaaataaattttattgtgtattttaagattcacaacgtgacgttaaaagatacgtatagatagtaaaatgattactatagtgaagcaaatagtaatcattaagtaacataatatagtaatattaagtaatagtaatatagtaagcaaatgtatctatcatctcacactgttacttttttgtgacaagatcagctaaaatctatttaacaaaagtccagctgagcacagtggcttccatctgtaatcctggcactttgggaggctgaggcaggaggatcacttgagcctaggagtttgagaccagcctggacaacatagtgagaccctgtctctacaaaaatacaaaaattagctgagtgtggtggcatgtgcctgtagtcccagctacttaggagactgaagcgggaggattgcttgagcccataaattgaggctgtagtgagccatgattgcaccactgcactccatgcactccagtctgggtgacagtagctcccacttataagtgagaacatgcagtatttggttttctatgtctgcattaatttgcataggataatgtccaccaccggcatctatgttgctgcaaaggacatgatcttgttcttttttatggctgtgtaatattccatggtgtatacgtaccacattttctttatccaatccaccattgatgggtgcctaggttgatttatgtctttgctcttgtgaatagtgctgtgatgaacatatgagtgcacatgtctttttttttttttgagacaagatctcactctgtcactcaggcagaagtgcaatgacatgatctcagctcactgaaatctctgcctcctgagctaatgcgattctcctgcctcagcctcctgagtagctggggctatctataggcacatgctactgcgcccggctaatttttgtattttttgtagaggcaaggtttttccatgttacccaggctgctcttgaactcccaagctcaggtaatatgcctgcctcagcctctcaaagtgctgggatgacaggcatgagtcactgcacccagcccacatatctttttgatagaaagagaaatcatattttcagactctttagtgacatagccaaactttatttcaggtctgttgagcaccaatatcttagttggggattgggaattaactggtaagtcagaatccagtaccctcatgaactcatcctgtagagagaacaatgtaaatgggacgtcctaggacttacatggtaaatgtattgattagcaaaatggctttaattttccaacattaatgaaagaaaaccatgagtgaaactcacatatatgcaggacacaaatttaaagtataatattttccagacacagatattgtgaaatatatgtcactaaatagaaagacgctttggaaaattaagcctggaaaaagcaaagccaatttgcatagtcttaaacacataaaaaatatgaagtatttaaaaatataaataatattcaaaccaaatacatgaacatgaatagatgtttatgtaggtataagtgtgtgtgtctgtgtctgtagtgtttgtgtacatatgtatagaaacagatgattgacagagatagatgatggatagatagatgataggtaaatagatgatagatggatagatagatgatggactgatagttgatagatgataggtagatagatagatgatggatgatagatagatgataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatagatacatacatacatacatacatacatacatacatagatacatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcgatgggatttttctggtgacattcagataatattacgcaaacggatgggtgtgttgaatctggttggacaagctgtgatatctgaaaattatattttgaaaaagcgcaactgagatgtacatgatactggtgcccagaggttttgaatgttttgtccacacagccagaatcaagcctttaggaagaataaacatctgctttaatatataattttagcaattctcaagcaaacatatatttaccctgaaattatttatcccagaagctgtaacaataccccaagtcctaagaattgttgcttttcttattagaaaagttgatttgtggccattcctggtagagatatcaccttcctgccttttataattatcataggtggccgggcgcggtggctcacgcctgtaatcccagcactttgggaggccaaggcgggtggataacgagttcaggcaatcaaaaccatcctggttaacactgtgaaaccccgtctctactaaatatacaaacacatccgtggtggcgggcgtctgtagtcccagctactcgggaggctgaggcaggagaatggcgtgaacctgggaggcagagcttgcagtggccgagatcgcgccactgcactccagcctgggcaacggagcgagactccgtctcaaaagaaaaaaaaattatcatgggtttcccacagcagtgccctgaaataatggagtctactgatagaataaacatttattttcattttttaataatttccaccttttattttagattcagggagtacgcatgcaggtttgttacctgggtatattgcatgatgccaagatttgaagtacaatagctcctgtcacccagggagcgagcatggcaaccaatagatagattttcagcccttgtcccccaccttccttctccccttttggagtccccagtgtctattgttcccatctttatgtccatgagtacccaatgtttaactcccacttatgagaacatgtggtagttggttttctttttctgtgttaatttgcttaggacaatagcctccagctgtatccatgttactgcaaaggatgtgattttgttcttttttatggctgtgtagtattccatggtgcatctgtaccacattttctttatccatgtagattggttctatgtctttgctattgtgaatagtatgataatcatgcaagtgcctgtgtctatttggtagaatgatttatttccctttgggtagacacccagtaatggcattgctgggtcagagggtagttctgttttaagttatctgagaaatctccaaagtgctttccacagtggctgagccaatttatattccaaacaatagtatataagtgttgcatcttctctgcagcctcaccagcatctgttcctcttttatttttttgacttattgggttcgtgcaaaagtaactgaggtctttgtcattgaaagtaatgatagattgatagattatagatggatacattgaaagtaatgacaaagacctcaattacttttgcaccaacctaatagtagcctttccagctggtataataaacacttttaaaagtgatacttcctatgggccatgcactgttaccagtgtattctggatgaatccccacaacatccccggagacgagtatcatcttcatcatcatgtttatctccattcacagagaaggaggcaaaagtatgtggcctttggtggctgctcctggagataagccagggttgggctccaaagctcttactccctagctcagctacctcttatgcagggcaaagaagtcatgttgaatgatgaggaaggagagctacattcttctctgaagtctccagtagccccattagactcctacagaccgtcatttcacaggagtcagaaaaactccaaaaacttcccccaacctggcttcctgcttccttcgagcccagcgagaggctttcattggagataccacccttgccccacccaggggaaaatctctgatgccgaatgagtcatgcatttctgcatgggcaagagtccatcagcttggatctgaagagcaggtttctcaagaatgcagataagaaagtaaaatgtgcaaaaatgagtaggagaaatggccttatcagcaggagatgagacaaggatgagggtcttggctgagcctgttgtacagacagttgtgagtggtggaatcccagggcaggcctgtctgtggacagcaacacagcttgggcagcaaccctggacagggcagaactgcaaaggaggctgtaaacatgtatttctatgtcatatatatatataatttatatgaaatatttgagacacatatataaaatataacttaaccctttataatatatatatttatattatttgttatacatattagtattaataatttgaaagttatcatatatatgaatatatattatgtatttctgtagcatataatttctatatttatttatttatttcagttgatgttagaaaggtacgaatcatttccatggttgtaatccctgctactttggaggctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatattataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatatatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatatatgaagtctacagtgtttctctgttgggtatatgcaccaaaattaagaccttttctttttgttaaaaataatgcatttcaagatacaatggatcaccagctactattcattatagctccaatgtcaataactaaaatatttagaaataatttttcaagcagtaaatgagtatctcgaagctgactcatgaaagaaaacttgaatacatggaaaggaagagtggattgtatacatgtattagttatttcaaagttaatattgaaggctaaggtagctctgattagagcattaattactgttctctggggagtggtcattatagaggtgatgatgaaatacacactgaataaactgataggaaataaactttccagaaacatctgatgagaaagtctttggtagaaaacatcaagaaacacttctgtgatcataagaaatgctatcaaaaagataactacaaaaattaaaacgcagaaatacaagatttgacttttagatcaatgaagcagaaaataatagccttagagcaggtctgggaaagagaaggacattacattcggtacaataaagtttttaaatcaaggtggcaggggtgaaaggtgttggggaaagtttgtgttatgagttgacttacatccccccaaaaaggtatgttcaagtcataatccaaggtatgtgagaatgggatcttatttggaaatagggtcgttgcaggtggaatcaagttaagatgaggtcattgggggtgggtcctaatccgatatggtgaattaggatgaggctgctacatgccaaggaaggctaaggactgatgccaactgtctgaagtgaggaagaggtaaggaaaggtcctcccctagaaacttcagagagagagagtgactctgccaacacattgattttgaacatctggcccccagaactgtgaaagaataaatgtttgttgttttaagccacctcatttgtactaatttgtttcagcagcccaaggaaattcacagagttagtttaggaaaaaccattaccaattcaattagcatgcttttccatacacattaaggacattgagtgaaacaaaacaaaaattggaagaagctatagttaaacagtaaatttacatctggatgaggtatagtgttagtaatagcaaaaggttatctgataagtagcatgactaaaggccctatgcaaactgaggaaatattagcaacaacatgacattgttttaactgcttgacaaataaagagttcttataaatcaataatggaaacacataattccttccaaaaatatcagcaaaattttaaacatcttttacagattaaaagtacaaatattagagtggacacaggaggaaactcatgatcattcataatgtaccataatcacctatcaaacattagatactgatgaggaattgagaaaatgaactattattaatgccaaaagttgttcattatggcattttaaattatggcaaagtatgaaaattaaccagaatagtgaacaacagtaaaatggttaaataatttatactacttaaaaataaagtatcataaattgtttaggccaggtgtggtggctcacgcctgtaatcccagcactttgggatgccgaggcaggcagatcacctgaggtcgggagttcgagaccagcctgaccaacatggagaaatcctgtctctactaaaaatacaaaattagctgggtgtggtggcgcatgcctgcagctgaggcaggagaaatgcttgaacctgcgaagcggaggttgcagtgagctgagatcgtgccattgcactccagcctgggtaacaaatgcaaaactccatctcaaaataaaatatatatatatacacatacacacacaacacacacacacacacacacacacacacacacacacacacaatggacacttttccagccattaaattgtacatataattttttaaatttatttttttaattgagacagggtctcactgtgttgacaagggtggtctcaaatacctgagctcaagggatccgccttccttgccctcccaaattgctgggattacaggtgtgagccatgatgcccagtcttgaataattttttaacacgaagattttccgagaaataatattggatgaagaaagcaagttgaaaaccgttcatacaatatcaacccaaatagagagagagagatgcatctacaagagtatgtgatatggtttggctgtgtccccacccaaatctcatcttgaattgtagctcccataattcccacatgttgtgggggggacctggtgggagataattgaatcatggaggcagtttcccccatagtgttctcatggtagtgaataagtctcatgagatctgatggttttataaggggaaactccttttgcttggctctcattctctcatgtctgccaccgtgtaagatgtgcctttcacctcccatcgtgattgtgtgtcctctccagccacgtagaactgtgattccattaaacctctttttctttataagttaccccgtctcaggtatgtctttattagcatcgtgaaaacagactaatacagtatgtaacaattttttttaaatagtcaaatggcaatggggcaggaaattggtggtctttattttcctccttataattttctttatttttttgtatttcccaagctattttgtatttttataatcagaaaaatattagctttgttgttttttcttgctacttttcactatttactgaaaagtagcaagaagagtaaaaacaactcccgtgtccccttcacccatctttcccaattgttagcaatttatcaaatatatcttctctcgcccctcttcctttctcctgatcatcctctttcttcctctctctctctttctctcttccacctccacatgtttcttatgcttctgaatatttgggaataagatgcagatatgatgttcattaaatttagaaactttagtgtgtattttctaaaacaaagacattctcctacatcatcactgcgaatcatcaaaatcgggaaattaacatgggtggattcttaggatttaattcacaaatcccagccaaacttctccagctgtcctcaaaagaaaatttatacacagcaagcaaaaccaatggacaaacaaaaaccaaccaacaaaacccctacttcctctaccctctttctgttctggtccatggattttcttgttgtatctgtttaaactcctctgatctggacaaagactgagcaatctttattctttcttgaattcaaagaccttgacattttctgagaataaagaccgggtatcatctagaatgtcccttgaattgggttggtttgacatttccttcaatggaagtggaagtgatggtgtgttctcaatccagtagacaagtaagtgaattagccccaacaatggttataaaattcttcatctcttgattaaatggtgtcttccagttttctccactgtaaagttacttattttgtcattacttaataatttgagatttttaactattttatgggagatactttgagatgaagccaatattttggttcttatcaaacatttaatgccaggtttagcatccattgatcattttctcttggatgaattttcagtgcgatttttgctaaaagtattgtggtaaatttttaaaagtattttaaaatataaattctttcttaacttgcccttacttgtgtgccttggctctagaagaaaatttctaaggtatagtactttaggaatgttaatgtaatgttatctgagataaccaacagtagaacacatagaattagacacgtttgagactaataagctttttcataattatgcataatacagactgggtttgggaactctaggaatttagctattttcctataaaaatgattggaaatgtggtttattttgaatacattcttcctcttttaacttgcccattgagtctaattctcccaacctagtcatcctattctctatttaaaatatcaaataagaagggaagggaaaatggttaaagaattacttatctaaatcatctgcaagaatatatcaaataaattatgtgaacccaacagtgggagtgtcttattcttgcctctgtctcctcaaattctgtaacaatgtctgccttctgtgagcagagaggttgcataaaccgtgactgccattctgtgcaacatcagtcagaataccactacagtccttcgtttcatatccagtgggaaaaactgtatttctctgtttaatgttttcattctgcatgaaggaaattatcaaggagaatttgtccttttaaatgataccagtagcaactgatgttcatttgtattgccataatatttttttcttaaagcaggtcatcttttatttcttaaaaattttggactctcagttttttgtttttttgttttttgtttttttgagatgagtctcactctgtcacccaggttggagtgcagtggcacgatctgagctctctgcaacctctgcctcccgggtgtaagcaattctctgcctcagccacctgagtagctgggattacaggcctgtgccaccatgcctggctaatttttgtgtttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttgtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatttatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgtatgtacaccacgttttctttatccacctgttggttgatgggtacttaggcttgttccatatctttgcaattgagaattgcactgctataagcatgcgtgcgcatgttagacattgtatgtttgcttatgggaactgtttttaaaaatttttggctcatgcctgtaatcccagcactttgggaggctgaggcaggcggatcacaaggtcaagagatcgagaccatctggccaacatggtgaaactccatctctactaaaaatacaaaaattagctgggcatagtggcggacacctgtagtcccagctactcaggaggctgaggcaggagaatggcgtgaacccaggaggcggaggttgcagtgagccgcgatagcaccactgcactccagcctggcaacagagcgagactccatctcaaaaaaaaaaaaattaacttttcagcatgccatgacataatgtagattttactctgattaacttaataaaataagagtcaattaacacaggacagtggccacttctcctaatttccccctggaaatcctggtgtatgcctgtcatcttggtataattaagacaactttctgcttttattctcaataataccttgatgtggacaataagttaccatatgtccatagtattccatttgttttcaaggtgcatgaatcaacagtgagcaaaataggcagaaatcctcgtcttcatggagtttatatcctactggagggaggcacagcagaaaataaaataaaataaataaataatatggcatattagaaggtggctgtaaataagaaaaaacacgagagtaaagaattctggggtgggactgccatttcaaataaaatgttcaggcacgcctcattgaggttactgtgagttccataaaattgggggctggatacaagaaaaatattaattaaaaaaaatataggaagttactttgagcaaaggtatgagggaggttggaaatgaagtaggtgtatatttgagataagaacactttaagtagagaaaatagccatgcaaatagaatgtaaatgtccaatattacatatgcttagttatttaatcaaaaacctaccagcagcacaggaaaatataattctgtagacgtgcactacttaccccactaggactctacatagagtagacactatacaaatgtgatctcttttgatactagcttaccttttaaatacattcaatacagtgactattttaactaggcacaataattgaacttaattgcattgtcttataggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacaggtgatgtcatataaactgttaacaagagcttattttcacccttcttccttctcagaagattcagaacaaggagactgactctatcctggcagacccactttttccctagtatctacacagttttaccttcctatatgactgtgtctattcagcatttttcagaagagaccagtcttttctttttttctattgaggtaaaatatacatatataatttaccatctttaccatttttcagtatacagttcagtggtaataaacatacttattttctttttttccccttcattttcctctcatctctcccctctggtcatcactattctactttctatcttcctaagattcactattatttatttttagctcccacactgagtgagaagatgtgatgtttgcctttctctgggcttggcttatttcacttaacataatggccaccagttccattcatgttgctgcaaatgacaggaattccttcttttttagggatgaatagtattcccttgtgcatatataacactttttaaaaagttaatttgtctgccgataggtggttaggttgattctatagcttggctattgtgaagagtgctgcgataaacatggaaatgcagctattcctttgatctgttgatttcttttcttttgggtgtataccaagtagttggatttctggatcacatggtagctctatttttggttttctgaggaacacctcaccacgcaaaacagataaagcaaattacaaccgaaaatagagatggacagatttataaccagaggtcctgaacaagtatcagagaccagtcttagatactaatctaatgcggaccatcttagatactttaacattttcaattgagagaaagatggagacaggaagctttggagatgaagacatggtaggtaaaactcactcatctctataagaaagggaaaaataatcctagtctctggtgtgaaagatctggaagactgagaagaaggtaagatatttgaggatgctttgaactctatcatgaatactttgaatttcttcaagaggagatcgttcatactacattgctccattccctggcagcaaccagcctaggtaggtttgctgctgattgacagttcattgatcacagctctgcaagggaatccagatgggttagaaccgcagctatgtctctcctccaagcccacagagttcttgtaatatttctttcttcacgtaacaaagctaatctatttctgaagaaataggttctgttggcactaatacagaaaagaaaaatattttagaagtcatggttaacttactgaaaaacaaactatcaagaactaatcaagacacatccccaagtttgcctttctaatatttaaaaatttatgtttgatgctagcagatatctctatcaacacactaaggctggaatttattttataattttcgggactgaactttagatgaagacatttttattttctgcctggaaagaagttagtcattgatgatgctaacacaggaaagaaaaaatattttattctttatttttatttattttatttttgagacagagtttcgttctgttgcccaggctggagtgcagtggcacgatctcagctcactgcaacctctgcctcccgggttcaagtaattctcctgcctcagcctctccagtagctgggactacaggcaccggccaccacgcctgggtaatttttgtatgtcttgtagagatgggttttcgccatgttggccaggctggtcttgaactcctgacctcaagtgatcctccctcctcaacctcccaaagtgttgggatttacaggtgtgagccatcatgaccagcccagaaaaaatatttaaaaaaccactgtgaagttattgcaaaaagaacctatcaaaaaactatggagaagcccagctttcctgttctaccatttagaaatagttgttttaagaagtctgtcgttccacatagcccaacagcctgttagggagacggcaaatgtccaggcacaatattgttacgttgcatgagggtggaaggcaactgctgccaagttccagccgttgtcctcacgttaaaaagaagaacgagttgattggagtcactcatcactccagtgcattcggcgccatgagattacatgctcatttggtcaggggtttagggttatgagtttggtgtccttgataagatgtatagtacagctgtcctttcctgcctgcaaccatgactccactagccataggctaagtcttcagaggacgcaccatctttgtagttcaacgggaagtggaagaatatcgcgaagatgactaaggcactgtggtgggagacctaacctcagcttcacgtacaggtcggcgtgccgggtactactcatcaggttgattttttggttattcctatgcttggttctcccaagcctctttatttgaattcatgacttctttggcatgtgcattgaccagttaaatatgtccttgctaatagagaatagctgtactacgtagaagggaacaaacagcaaattcacagtatcaggctcactgtctatgacaccagcatcatgagggcctgtggatacctctctcctgtctgcttcaatccccaacacaatgaaatcaacaagaagaactcaaaagcggctctcacctgtacagaaatgaaggctgctaatactgtaaaagccaaatagttatttatttttagaattaacacaatttgtttcaccacctcatcacacaaaacagataaagcaaattacaaccaaaaatagagatggacagatttataaccagagatcctgaacaagagtgtagaatagacaaaaaagaaaagtaaagataaaacagaggacaccattaatgtgtagaaacacgggaatctgaggatgcaatggtttatcaaagtgttgggaaaaaatgacttatcaggtatgtggtttaccaatacagctgtcccttggtatccatggggggttggtctcaagacctcacgtggataccaaaatacccagatgctcccgtccctgatgtaaaatactgtagtatttgcatattacctacacacatccttttgtatatattaaatcatctctagattactcataatacctaatacaatgtatgtaaatgccacataaaatagttgttatattgtaccctttagggaataatgacgagaaaaagtctgtacatattcagtacaaacaagaccgtccctaaaaggaccataagcctaaatgtaaacccaaaattataacacttctaaataaaacataggagaaaatcattgtaatattcagataagaaaataatttttttagatttatcaaaaaagttgcaagctataaaagaaaaaagtgatagattagtcattatcaaaatttaaaatttctgcttttcaaatgtcaatatcaagtaaataaacatgtgacctcagtccattagtggagaaaaaaagaaaagaaagaaaaaattaaaatattaaatatgaacttaaaagaaagtttaaaagaaaagaaaaagacaagccgtggagtagaagcaaatagtcatccctctgaactcagaggttctgcatctgcgaattcaatcaactgcagatcaaaagtatttcataagattttctagaataaagaatctagaatagcctaaaattttttgaagaagaaaatcatttgaagactcactacataattccaaaatttactataaagctagagtaatcaagtttaaaagagtaatcaggatggtgttctaatgctctaaatttttaaaattgatatttaatattttaatttttttctttttttctttttccccactaatggagtgaggtcacatgtttattttcttgacattgccatttgaaaagcagaagttttacattttgataatggctaatttatctttttttcttttataacttgtgatttttgtgataaaacttaaaaaaaattttcttatcaaaagatcacagtgattttctcctatgttttcacttagaagttttatagttttgggtttacatttaggcttatggtccacattgagttaattttttaatgtggcttgaggtataggctgagatttattttccttgcatttggatatccaatttgtctactgtcatttattgaaagacagtcctatctctactgaattattttgagcatttgttgaaaagcagtatacgtgttggtcaattcctggactctcctatttcattgatccattgaaacccttatttcaacactacactgtctcaattagtctagctttatagtaaatctgggagttatgtagtgagtcttcaaactattttcttcttcaaaaaattttaaaccattctaggatctttattttcccatgtaaattttggaataagtttcttcctttcaacataaacctttctgaaattgtgattgagattgctttaaatctatagatcaatttgcagaaaattgatgtcttaaaaaactttgaattttccaatcaataaatatagttcatttctccatttatttctcttatttggtgctttgtggcttttctcatacaaatttttcacataaaaatgctatccctaaatacttcatgctttctcatgttatagtacatgatactttaaaaagctattcccagctattcattgcaaatatatagacatttttaaaagttgttattgtattgtgtgatcttgctagtcttactcattatttccggcagttttttcagtgataattaacataggaaatcattgtatctgatagtaaatatagttttatttcttttaagatcctttttaggcatggcacggtggctcacacctgtattcccagcactttgggaggccaaggcagataggtcacctgaggtcaggagtttgagaccagcctgaccaacatggtgaaaccccgtctctactgaaaatacaaaattagccaggcatggtggcacacgcctgtaatcgcagctactcaggaggctgaggcaggagaattgcttgaacctgggagatggaggttgcattgagccgagatcgtgccgttgcactccagcctgggcaacaagagcaaaactctgtctccaagaaagaaaaaaaaatcctggctgggcgcggtggctcacgcttataatcccagcactttgagaggccgaggtgggtggatcccctgaggttgggagttcaagaccagcctgactgacatggagaaaccccatctctactaaaaatacaaaattagctgggtgtggcggcacatgcttgtaatcccagctacttggaaggctgagacaggagaatcccttgaacccgggaagcagaggttgcggtgagcagagatcacaccactgcccctcagcctgggaaacaagagtgaaactccatctcaaaaaaaataaaagagaaaaatccttatctgggatgtattattatgtgtcccattacaaagcaggttttattattattgctttctaatacaaggcataagatatattttctaatataaatttttaaaattcattttagtttagattcagggtcccatgtgcaggtttgttatttggatatattgtgtgatgctgaggtttctattaaattcatcacccaagcagtgaacatagcgcccaacgggtagtttttcaacccttccctcctccctccctcctgcttttcggagccccccagtgtctaatgttcccatcttcatgttcatgtgtacccagtgtttagctcccatttgtaagtgagaacatggtgattggttttctgtttgtgcgttcatttactccatttctcatataaaattagaagtatatgactttttagtgattacataaaattttttcaaagggtagcaatataattgcaaatgaagttcagatttatgaaattgccataaattgctgagctgtggagagctctgtgtcgcagccaaggctgtctgatcttttcgcctttggggcatgcattgtcacattcctcggcctcatcatttcaggatcagaacttagctttcttctcttgtccactggagtgtaatctcccagagagcatgcatgagttttcctaaagactcagtacgctgtcctctggacctgaggcatgacgcagtcttcaccaagtacccttcaggtagcttgggacccaacgtcccttctcctcattttccttatctgcactgtctgtgtctctgcagggtcattgacggccgagacctcatgcccttgctgcagggcaacgtcaggcactcggagcatgaatttcttttccactactgtggctcctacctgcacgccgtgcggtggatccccaaggacgacagtgagtgctcaacccgttgcttcctgttccctgccaggagcagggtcactcaggtgtatcctgaacgcattcttcctttcctctctagaccggtcctttcattccagggctcactgaacacatggttttggagaagtttctcagaattgctcttctgcagaaaggcaggtgggggtaatggagatgctaattggcttcacttaattatctcagcagtcgcacatacattaaaacatcacattgtgcatggaaaatctatgcaatttttacttatcgattacactttaataaagaaaacagatgtatgaacataagatttgcctataaagttagagagacacttttacgaaacatacatttttagtcaggtgtggtggatcacgcctgtaatcccagaactttgggaggccgaggcgggcagatcacttgaggtcaggaatttgagaccagcctggcaaacatggcaaagccctgtctctactaagaaatacaaaaattagccaggcatggtggtgcacacctgtagtcccagctacttgggaggctgaggcggtagaatcacttgaacccaggaggcagaggttgcagtgagctgagatcacaccattgcactccagcctggaagacagagtgagactccatctcaaacaaaaacaaaaccaaaaaatatatatacatttttagaaacaggactgatatctgctggaaaatgtgtatatcatttcaccagggaactctaatgttctcgttttgttgtaaggattgcataatatttagcattgacgtgtgggcaaaaagaagcccaagaaccagccttgagaagacggaagaagacaagagaagccagcaccttgggtgcatgcctctgatgtgctttctttctttcttttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataattggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcatcatgtagaatcagtgggagccctgagcttgctttcctgcaactagatggtcccatctgggggtgatgggagacagtgacagatcatcaggcattagattctcatacgtagcctgcaacccagatccctcgcatgcacagttcacaataggtctcgtgctcttatgagaatctgatgcagccactgatatctgacaggaggaagagctcaggcaataatgccaacgatagggaatggctgtaaatacagagataaagcttcgctctctcccccaaccactcacctcctgtgtgtgaccaggttcttaacaggccacgaacaggtaccagtttgtggcctggggactggggacccctgctatagaacactaggacttcttcctttgatctggctgaagtgcgcatcatttgacgagtctctcttttctcctccaggtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttccact

SEQ ID NO: 1327 - DNA, 71259 bp, Homo sapiens
agtggagacaggctctcaccatgttgaccaggctggtctcgaactcccgacctcaagtgatccgccggcctcggcctcccaaagtgctgggattacaggcgtgaaccaccactcctggcccttctgttacttttccactgctgttgagatagaagtcactgttgggatccaacctttttgtttgtataaactggtgagtttgtgttgatatctcttgctagagttctgaagtaaaagctataggatctttgtgtgagtgtgcatgcgtatttagatgtgtttatgtacatgcacatatgtgtgcacatatacattttttacgtgctttagccctgaagtgtcaaattggcttcaagtcaaagagtactcataaattaaataataagccaaaacgcttttcaagttcacgtgacttacataaatctttaataaataagctggctttaaaattattggtacgatagtattagaaatatcttaaaaattgtcagcatacatgtttgtttgcatttactgatcaagcagtttcatatttacctctgacagatattataaggtgtcaaaatttggcataaggcttacaaaactataaacccagcaacccagcatgaaacacaataatctttgtttctgtactttttgagaaataagacgtttaatgttattagtgtagtaaaaagagctaaatcccaagttatcagtaaaatatatatatatttaaaatttttgcttaggcaaacacagaaaattcatagactataaaaatggttaacagggaaataactttaaatgatgactatcagagttttcacagataatctaggtaaaagattttataaaattaattaggtaaatgtaatgaaacaaatgcctgtaaataaatataatttagaatctaaagttaaataatagatattcactaaatgtctgggccattttcaatttaaataaattgtattatagaaaaacttttctaaaaaatatgttcttattcaaagctaagttattttcatctaattccatgtttatttatttatattttttgagatggagcctcgctctgtctcccaggctggagtgcaatggtgcagtctcagctcactgcaacctctgcctcccaggttcaagcgattctcctgcctcagcctcccttgtagctgggattacaggtgcccaccaccatgcctggctaatttttgtaattttagtagagataggggtcttgccatgttggccaggctggtctcgaactcctaacctcaggtgatccacccacctaagcctcccaaagtgctgggataacaggtgcaagccaccgcacccggccagattctaggtttatttaagggttatttatgaaatatggtaaaaggaaccaagaaacaagagatgtaaagaaagttaggctgcgtgcattgggtcacacctgtaatcccagcactttgggaggctgaggcaggcggatcatgaggtcaggagtttgagaccagcctgaccaacacagtgaaaccccacctctactaaaaatataaaaattagtcaggcatggtggcatgtgcctgtaatcccagctactcaggaggctgaggtaggagaattgcttgcacccgggaggcagaggttgcagtgagccaagatcgtgccactgcactccaggctgggtgacagagcgagactactccatctcaaaaaaaaagaagaagaaagttacaaggaggtatttttggtaagaaatgttaaaagaaaaataattttgtatgagaaagaatcttgttgtttaagagagatgtttaggacagaacagaaaatccaagcaggttgtatatggtctgtgcaagtcataatacagtctgtaaaaaaggaattcaaaaaaatttttatgtaattaagtttgctataactaaaaggaaattataatcattctaggtattggacttcaataataaaaatacagtaatgcaaaaggagatcattggttagaacaagattttcttaaaatactgatgtactcagtgaaattgcaagaagttttttatttttgaattccataatctcttcttgaaattcttcagatggacatcctaggggttccacttctgctgcatcctgcttgcctcagagctttccctcttttgaaaaggcctgggatggtaactctctccttcaacttttgctggctcccgtaattttttaaaaattaatagtctaaaggaagagagagaatttttgaaaacaggcaagtgaaaaatgttataggatgtgcctctatctgtgtgtctgtctataagtttatttattgtctgtttgtttgattgatttgtttattttggagacagggtctcactctgtcacccaggctggagcgcagtggtgtgatcttggttcactgttcccttgagcactgggctcaagggatcctcctgcctcacctcagccatccatgtagctggaaccacaggtgcatactatctcgcccagctaattttttgtattttttatgtagagatggggttttgccatgttggccaggctggtctcagtcctgagctcaagcgatccacccgtcttggcctcctaaagtgctaggattacaggcgtgtggcaccatgcctggccttgtctgtaagtttctatctgtcatgaggaagtaatatttcagtaccaaattatatgaaagagctctaatcaaatggcttaaagaaaagtaagtgcttatcagacaaccaaaagctagctcagatgcttttaattgacattcctttagtaatctttggtaagactaatttggtaaatttaatttcaaaatcctgtccagtggtttaaaatcttagagtcacgttagatgggactgttcccctgaccttgacccccttcgtgggcaggaactggagtggctcatgttactcagcctgcagtttgtggacagctatgtgttaacagctcagtgaagggtcaaggtgacagccttctgcatctgtccttttggacaccgacttcttgtttggtgtccaagaatcatcaggtcacacaaactgaaagatgatgaatgtggaggactttattgagcagtggaagtggctcttggtggaagaggagctggaaaggggatggtgtgtgaagaaggtgatgtttctctgaagcctagccttctctggctgggctcccctccaaaaccacaccgtctgaagttagtcatgtttatctgtagtctccaatgctcagttacttctctgctcgccactcagtagcttgtatccctgccggtcagctgcttgtgttgcttttttctttttctttttcgtttttcttcctgccagctggtctggtccttatgggcacaggatagggggcagggcaggccaaaaaggcaatcatctgggcagagaaacgaggtcagctgctttcactagggccgagcttccagacttgaggttgtagtttagccgggagcccagccatcctgtatcaatgttagattaaattaggcaatcctaggttttgcactggaaattagggttactgggagttggaatagtaggagagtaagatgtatttttggtgaggtttataaaaacacaaagatgtggtttttgccaaagaaaatgtaatgtttagaggctatttaaaggtcactttaaaataaatggaaaattatgtagataaaactcattggagaaagagaaaaataaagaggtggggaatgagaaacctttgacttttgggtggccacgtggtcacacatggtaatgaagtggcatcattttctggggtaaatacccgagattcattgtctcatggccacagaaatcgaggacgtggacacacagaatgaggttgagagcagaagtttagtaggcaaaagaaagagaagagctctctgcagcagagcggggtcctggagaagtgggttgctgcttctttgctgaaatgcagcaagttttatagatgagcttgaggaggcagtgtatgatttacataggacgcaaaagattggttggaccaggtgtaccattttcatagggcatgtaaagctggttaggactagatgtgtcatttgcatagggcatgaaaagctgggctaatcttttttttttttttttttgagatagaattttgctcttgttgcccaggctggagtgcaatggcgccatctcggctcactgcaacctccacctcccgggttcaagtgattctcctgcctcagcctcctgagtagctgggattacaggtgcctgccaccacacctggctgatttcgtacttttagtacagatggggtttctccatgttggtcaggctggtctcaaactcctgacctcaggtgatctgcccacctcggtgcctaatcttttattatgcagatggactctttacctggctagtgccatgtcgcctgttttttttgtttgttttgttttgttttgttttttgagacggagtttcactcattttgcccaggctggggtgcagtggcgtgatcttggcctaatgcaacctctgcctcccgagttcaagcaattctcctgcctcagcctcctgagtagctgggattacaggcatgtgccaccacgcctggctaatttttgtatttttttaagtagagacggggtttcaccatgttggccaggctggtctcgaactcctaacctcagatgatccgcccgcctcggcctcccagagtgctgagattacaggcgtgagccactgcgcctggcctctggttttttactgtacacgtggtgacaaagaaaagggaagacggagcctccatgttgaacatacctggcttccaggtagccctttcccattggcacagctgccagcatttacccattcaagcttccagcttgcttattatctatgcctgcagctctattttccaggctgctctttgttaaaaagaaatgatttgggggctcctttttaaaaagggaaattctgccaaggactcttttaccctcactatctgcctgaataatttctttctagttcctctatcagtaaggagatgcagctggcttgtcttcagtcactaaaggtcaaagccaccagaggaatttagagatggatcctactcatagtcccagggaatttcgttcactggatatatagcaaatgcaaattaataaggaaaaagtgaactattcaatcccttgcttactgcctctgtagttgctaaaatgaaagtaaaagagtgctgccttgggcgtgaaggcagcaccaagctcagatgtgggtctgtctcagatcaggccagtgacctcaaagcttcctacacaaggaaaaattaagccacgtcaaccaaaagttacctctgagacctgtgattaccaagaagatagacatgtggaggaagggcaaaaccaagtaactattaaacccagagggtatttacagggctgttcaatcttttggcttccctgggccacactggaagaaaaattgtcttgggccatgcataaaatacacaaacactaatgatagctgatgagaaaaaaaaaaggcaagaaaatgtcgtaacattttcagaaagtttacacatttgtgttgggccacattcaaagctgtcctaagccacgtgcggcccgcgggccgtggattggacaagcttgaaaaggaattggttcatcttctagattggtatcgtcagcttcctgagttcccttttctaaaatgggttgtaagaatgactactttaagaacagtatgtttaatttttttttttttgagaaagggtctcattctgtcacccagactggagtgcagtggcatgatctcagctcatcgcaacctccacctcctgggttcaagtaattctcccacctcagcctcctgagaagctgggattacaggcacacgccaccatgcccggctaatttttctattttttggtagagatggaatttcaccatgttggccagactactcttgaactcctgacctcaggtgatctgcccaccttggcctcccaaagtgctgggattacaggcgtgatccactctgcccaccgatatgcttaatttttaaatgccacagaaagaaagagcatgtttgggctggtgcagggcccgcagctcactcactattaaacacttgctgatgagtgtatgggacccagatgcacaggaagtttttcctgaggaaatggccagcctggtggactaggtaaacaccactacaaggtctgtttatcctgaaaaggggactgcccagccctccctataaaatgccaagtggagcaccctagataaagcagctgatgtgcttcatatgcaagccatgtgggattggcttaatgatgaccgggatattcaccagctgaatatgcccattacccaatgtattagtccgttttcatgctgctgataaagacatacccgagattgggcaatttacaaaagaaagaggggtaattagacttacagttccacgtggtgggggaagcctcacgatcatggtggagggcagggaggaacaagtcacatcttacatggatggtggcaggcaaagaaagagagccaagcgaaaggagtttctccttgtaaaaccatcagatctcgtgagactcattcactaccacaagaataatatggaggaaactgccaccagaattcaattatctcccaccaggtccctcccacaacaatgggaattatgggagatacaattcaagatgagctttgggtgtggacacagtcaaactatatcaccgaggtcatagtgtgaaaggaaaataaatctcaggaccccaaaatcactaagccaagggaaaagtcaagctgggaactgtgtcaggcaagcctgcctcccatttgattcttaaataagacagctacaaagataagaagctacatacccccctcacaatttgtgcttaaggaaattccttgtggacaaaggacagacggaactcaaagtcatccttccaaggctcccctgagacaaatgcttatctgataacttcctctgcctcattgcttatgtaaaagtacagattcacggagccagcctaaattgtgtattcagtggaaagctgatcaaggactcaaaagaatgtaaccttttgtctcgtgtctacttctaatctgaaagctcccacttcaagttgtcctgaattactgaactgagcccatgtatgtcttacacatattgattgatgtctcatgtctccctaaaatatataaaagcaagctgtgccctgaacaccttgggcacatgtcgtcaggacttcctgaggctgtgtcacaggtgcacgttctcaaccttggtaaaataaactttctaaattgactgagacctgtctcagatattttgggttcgcaatagattctcagtgtattaatgatgttaggtgaagaactgtgaagctcataaatttggaaaggaaaggtttatttctataaatgttgtggttcaagggtccccttctacaagagcaccccaggtgacattactcttgcagaatcaaacaatggtttgagaaaccttatcaaatttgcagttgtagctttccctcatgggtcttacagatgctaccaaaagactagggtgtcaacgagaagagacaaactgtaaatttttttaagaggtttattctgagccaaatatgagtgaccatggccgcccgtgacgcagacttcaggagatcctgagaacatgcgcccaatgtggtctgcgtacagcttggttttctacattttagggagacatgagatatcgatcaatacatgtaagacgtacattgtttccattcaaaaaaggtgagataactcaaagtgggggattccagctcatggatggacaagacacagaaggttgcattcttttcggtctttgatcagaatacacaatttacatgtgacggaggttggggggtgggggtggtgggtagaggaatagtgactgatgcctgttcagtgaatctgcaagtttgcgtaaacaatagggcaggggaatctatcagatatgcatttgtctcaggtgagcagagagggctgactttcacttctgtctctcctttgacccacacctgtgaagataagccaaggtgaaattgaacagaactgttttagggtaaagatcttgaggtccacaaaaaatttctttgtgggcaaattatgaaagaggtatgtagctttttgttttgttttgtttgtttgtttgtttgtttttgtctccatagctgtcttatttaggagaaaatgggaggcaggtttttctgatgcagttcccagcttgccttttccccttggcttggggattttggtttcctttcactaattaacaaacaaaattaataaattaacaaacaaaaacagggaagggaaaagtgagtcaaagggctcatgccagaagggtggaaatctttagataattattttgttattattattaatttttctttttttgagatggagtttcgctcttgttgcccaggctgacatgcaatggtgccatcttggctcactgcaaccccacctcccaggttcaagtgattctcctgcctcaacctcctgagtagctgggattacaggcacctgccaccacgcccagctaatttttttgtatttttagtagagacgaagtttcacaatgttgggcaggctggaatctttagataattgttaagaaataaaagaaaaggaaaattgatggagttaaaacaaaagactttacaacatgatcaaaggttgggtgggccacagggagccccaactggtcccccaacatgaaggggccccatgccagttttcttcatttgcctcagattggagaagtttaagaaaaattgaggctgggcatggtggctcaagcctgtaatcccagaactttgggaggccaaggcaggcggatcatctgaggtcaggagttcgagaccaggctggccaacatggtgaaaccccgtctctactaaaaatacagaaaaatttgctgggcgtcgtggcacgcacctgtaatcccagctactcaggaggctgaggcaggagaatcgcttgaacccaggaggcagaggttgcagtgagcagagatcatgccattgcactccagcctgggcaacaagagcgaaactctgtctcaaaaaaaaaaaaaaaaagttttagagcaggaatgaaaagaaggaaagtacacttggaagatggccaagtagctgacctaagagatcaagtgtatggttgacctttagacttggggttttataggttggcatgcttctggagtcttgtgtcccttctccgctgagtcttcccttggggttgggctgtccacatgcacagtggcctgccagcacttgggaggggagcatgcgcagtgtgtttactggagttggacgcatgctcacttgaggcgttcttcccttaccagctgaatgttcctagaaggttatagaccagttaaactccaccgttttgcttctcagtgtgcatgcttgagcccactcactcacctcctgagatcgtattgggaaactgctgaccaccagttttaggtgttttctatttactgggagacggcctttccctggtgctgactgtgaccaattattattttagagagacagtttaataaccgcctgatgctcgcctgacattcctggtggggctggggagagcctttcctgccttgctcatgcctgactagctacctactgtaacaataactgaactctttctaccgatttccagtgagaaaatctatgcatctatctatgacctgcaagcccccactttgaagtgtgtcacctttcctggctgaaccaatgtccatcttacatgtattgaggggtgtcttatgtctccctaaaatgcataaagccaatctgtaactcaacaaccctgagcacatgttctcaggatctcctgagggctgtgctatgggccagtagtcactcatatttggctcagaataaatatcttagaatagtttacagagtttgacccttttcatcagcagaggcatacactcttgctatgggatgttaaccgaagctaatggaaataatggtgtccaaaagagttccgtgatgaaacgtaaatggttcatgtaggacctgctacctggggaatgcaaagataatatacaaggagggagcttctttttcctcttcagactgactctgtaactgtgagaagatttttgccttccaaagttattagtgtgttcatttttatctcttaggaaaaaagtggcaaagttggagatggtgtacactttcctttattgcttgactgaggttaaaaatttggccaggcatggtggctcactcctgtaatcatagcattttgagagcccaaggccaaggatagcttgagccaagaagttcaagaccagcctgggcagcatagcgagaccttgtctctacaaaaaataaaaaaattagctgggtgtggtggtgaacacctgtaatcacatctacttggggggctgaggtgggaggattgcttgagctcaggagctggaggttgcagtgagccaagattataccactgcactccagcctgggcaaccaagcgagatgctgtctcaaaacaacaacaacaacaaaaagaacaacaaaaaacaaaaaaaaacttgtattctattgtctcccatcagattatttttaactaattttattttaatcacttactgttgagtcacctctgagattttctattccagtggcgtccttataaaatgaagcttccttgtcaactgcacttgttataacaccgagcttctgctaagaaaaagcaaatgcataactctgtataacctatctcccatgacagggtctatgcctcgctgtatttaagcattcattttagttttcagcaatgtagtactttcacctatattttgtcaaattcaaacacttgcaatacttcatttattttttctgcatgtccttcatattttggctttgctagtccactttggccaaaaagctttgattctttaagtataggcctaaatatcctatcttaagcatgggtgtaattttcttctattaccaacagaggttcttttatagtttttgaaatcactgattaaaaagaaacagctcaaattatattctactgtaaaaatgatacattcagcctgggcacggtcagtcacatctgtaatcacaatacgttgggaggctgaggcaggaggatcacttgagtccaggagttgaggctgcagtgagctgtgatcacaccactgcactctagtgtgggtgacagtgagaccctgtctcaaaaaaaaaaaaaaaaagatacattcaaagaagtcaaaataaaacagtataaaacctatctccctgattgcagctacctttttttatgcatacgcctgcaatccttttacacctatcacacactaaaaatgttttacagttattgttattgcacacagaaggcatctaggaatgttttaaagaacctgtctctctgaagttcatcctgcttatctaacttgtctatcaaggaaattattttcttgattattattgctgagaaagactgggtgaggttgctaccccagaattagcagatgcaaatcaggaggaagtgaacaggctgcaaattagcaagttctggcatggggtgaggcaatggcagaaaatcggtttcctgggaaccatgcccaggaactagcctgacattgtgagaaagctcccaacattcataatgagttgcatattaaattccagggaagggcactgtaggtaagatggaccacatttggaaatacactttttcagacgttttatttagggagaatttctgacatgtcctccgataatttgaacttccttgatttgcagttgtacattgagagatcatttcttggtcaaaataaatgttcagcaggtgtgaatgctgtatccacaacttttttttttttttttttttgagacagtctcactctgttgcccggggtgaagtacagtggtgtgatctcagctcactgcaaactctgcctcccaaattcaagcaattctagtgcctcagcctcccgagtagctgggattacaggcatgtgccaccatgcctggctaattacaacttaatttttaaatttgggcagatttacaaaactatcaagctattaccctgcagcatccttagccctaagcttgtcactacttgtaatgtatttttattttatttatttattttttgagacagagtttcactcttgtcgcccaggctggggtgcagtggcatgattgcggctcactgcaacctccacctcctgagttcaagcgattctcttgcctcagccttccggaccacaggtgcatgccaccacgcctgggtaattttttttttttttttttttgaggtggagtttcgttcttgtcattcaggctagagtgcaatggtgtgatcttggtttactgcaacctccacctcccaggttcaagcgattttcctgcctcagcctcccaagtagctgggattacaggtgcccaccaccacacccggctaatttttgtatttttagtagagacagggtttcaccatgttggccaggctggtcttgaactcctgacctcaggtgatccacctgcctcggccttccaaagtgctgggattacaggcatgagccactgcacccagcctacctactggactttttttcggagacacactgtagtttctcaagaaagaatgcctgttcctggtcccagctgcacactcactttacagtgtgtgctgtacttggtcaagtgtattgatattgaaacacaagccagactggatggaccttggtcataaatcatggggcagctctccttcactgtcagataaaatccaaattctctattactacctccaaggtcccagcattgacgatctgttcttttcttcctgaagggacatcacccccggttctcagggtgtctcctcacaggcttcttacaaatgcctttcctcaggaatgtggctccacaatgacttttttttaattaaaaaatttgcagcctacaatcagcctcctcaattattattattattattaattgttattatcattacttgaaacagggggagagtctcactatgtggtccagactggtttcaaactccttgtctcaaaccatcgtcttgccttgacctcccacagtactgggatgacaggtgtgagcccccgcacctaagtgtcctcttaaaacccatgaagtcttttagggctgtctacttttctctatggaattcaaatcgctaagcattcatgaaagtttagataaggtggaaataaatccaacctttaggatggatgcatgaaactgctctcttttttttttttttggtagagttttgctgttgttgcccaggctggagtgcaacggcacgatctcggctcactgcaatctccgcctcccaggttcaagcgattctcctgcctcagcctcccgagtagctaggattacaggcatgtgccactacgcctggctaatattttttgtatttagtagagacagggtttcaccatattggtgggctggtcttgaactcctgacctcaggcgatctacccacttcagcctcccaaaagtgctgggattacaggcatgagccaccacatccagccaaaactgcacttaaaatccaatctttggccgggcgcagtgactcatgcctgtaatcccagcactttgggaggccaagacgggcagatcacctgaggtcaggagttcgagaccagcctgaacaacatggagaaaccccgtctctactaaaaatacataattagccgagcatggtggcacatgcctgtaatcccagctactcggaaggctgaggcaagagtatcacttgaacctgggaggcggaggttgcagtgagcccagatcgcgccactgcactccagcctgggcaacaagagcaaaactccatttcaaaaaaaaaaaaaaaaaaaaaaatctaatattgtccccaattcctacttttgggagtaaactatgcctatttcaaactattgctggacaagattgcctggtttctgcttccccttatccctcttgttcaagtcaaccagtcaggaaatataaagaatgatcaaggaaacctccaagttaacacagaaatacgtatatatggtgaatgctgtctgcagacagcttatggccccatggtactagccgtcatagcacatggcaaagttgtcctattgactctgctgtcagcccctgcgtggaagaccaaataaaggtgctgggacagaaggatgaaaaggaatcctaggataaatatctcatcttcatcgtccctgggttggataattctgagggtctgtcgttgaatctcagtgtttctgcacagcactcagcttcaatagcccagtggcaagctgcttcataagtacaacctctactggcttcctgcctttccctgtctctcttcctctttccctgaccaatgctccctcaattacctccctaataacctacttggatttaaggtttgaaaaagaaatgcggcatcattctttttgtcttaaatttttaattaaaaaaaatttttttcgagatgggatcttgctctgttgcccgggctgtagaacagtggtggaattacgatacggctcattgcagcctcaaaccctttagctgaagcaatcctcccacctcagcctcctgagtaactgggaccacaggtgtgtgccaccgtgcctggataatttttgtaaaatattttttgtagagacagggtctcactagttgcccaggctggtctcaaactcccaggctcaatcaatctgcctgtctcaacctctcaaggtgttgggattacaggcgtgagccactgcgccgggtcgcaccatcattcctattttttttttttttttttggaaatgaagttccctctgtcacccaggctggagcacagtggcgctatctcggctcactgcaacctctgcctcccgggttcaagtgattctcctgtctcagcctcctgagtagttgggattacagtcatgtgccaccacacctggctaatttttatatttttagtagagacggcgtttcgccctgttggccaggctggtctcgaactcctgggctcaagccatctgcttgcctcaactcccaaagtggtgagattccaggcatgagccaccactcctggacgaagcatcattcttaatttcaatgtctagtctagacatttaaaagaattgaacatattggatcgtatcaaaacaacatcttgttgaagagaatgaccctctccacccaacctgaaacagatggaggcagtgctgactttatctcaatcttaaacaaaatctgtttcactcaattttcttgtagacaggccgactgctttattagaaaacaggagaacattgacctttttctatgattctcttccgatcaccctaggtagaattcctttcactttctaacctgtgtctgtttcaacccaggatacattaagcttgttgtctgtgacactttattgaactttttaatagccacgactgacactgatcctctctgctgagagaggagctattctgattccattcattgtgactccaaagtctaccctggaagtcagatgctcaggtgggattttataaatattccatgaacaaatgaacttcggctttggggtaaaagagtcggttgcccatcatttgatagatccctggatattttttcataaaaaacaccctagcaggttgcttattgcaaaatgacatgtgtcatatcttctctggagctgaatattgttaagcaaaatttatattaatgagaagcaaaaaaaagtttgtttgttttgctttgcttcagcaagaattatctgttgcatcagaaatgcagggagcacttttgctctttattagcgtttttttccccagaaactctgacattactaggacacttggtcatctgtgatctgcttaaaagctctcttcagctcctggaagagtaggtggttctgattctctttcggtgagatggtttatggagccctcttcatcccataattctgaagagtaacaggcagaacgtcttattagggggcagctgaaatcgtctagggaatgtggctagggagtgtcgtcatctttacatcaaaggctatgcacagataacacgccaatcctgatttcacccatgagaaaagtgaactccaagaatttcaggaatgtagacgtgtcgatgataaacattgcatttattacaatttcactttatttcctagaagaggggacattatatttcctggccagatgctaccctttgaaagaaatgcaaactttgataaaatagacatgctatcaatttccttaggggagctttatcttcactgggtcactatacccagcatgacagtaaagtctgccatgtgtttcttgtcccactggaaaaaaatacatagaaaagctatgtacaaggactgtattaagattcatctatgtctttcagagatggcaggcaagtgccatttctgaacaatttgggtgaagtcagacacatgcaccttaccccgacaaccactcaatggacagcagaacattgcaaatcatgacctgtaataggactgtctttgacttacacagctcaggaaacaacacttggtttggtcaaaggtttgttccttttcatttcgtgttctagtgttttcttttcctgcccttatgacagttgtgtgcaatggcattattgcattaaatagacacgactgattaggtagcatgaaccatagtttagaatttggctaagtgtggctatgttactgtctgttttttctttttctttttttaggagatagggtcttgctgtgttgcccaggctggagtacagtggctattcagacatgtgattccaccactatcagcacgagagttttgacctgctgcatttgtgacttagggtggttcaccaggccttaggcagcctggtggtcttctgctcctgggaggtcaccaagctggtgctgaacgtagtgcagatacttgatcagcctagcgcaccatagcccagaacttctgggccgaagcgatcccccacctcagtctcctgagtagccgggaccacaggcaggctacttgctgtttttgtcaacataaaagggagtcagaaaaggcagaacatatcaagatcagtaaatctaggctgggcatgatggctcacacctataatcacagtgcttcatgaggccaaggcaggaggattctttgaggccaggagttcaaaaccagcctgggcaatatagggagaccttgtctctacaaaaaaatagaaaataaagaaattacccaggtgcagtggtgcatgcctgtagttccagccactccagaggctgagactggaggatctttcgagcttaggaggctgaggctgcagcgagctcttatcacaccagtgcactccaacttgggtgacagaatgagaccctgtctctaaaagaaaaagaaaaaaagagattagtaaattctttagaaaccaagattttaccatgagcagttgcatgaaggtggaaaacctttctgtgattataagtagggattctgaaagaagtcctcaaagtgaatacttattccatggagaaacagaatgaattgagagagtcctggaagctgggaggagaggaatctgtagaaagcagagtcacttaactaattcaccaatgagactgcaaaccgatggtcatggagctgccatgggaatctgaattacagtcacttttattctttgtattttattgtttggattgaaaatgcggccaggcacggtggctcatgcttgtaatcccagcactttgggaggctggggtgggtggatcacctgagatcaggagtttgagaccagcctgaccaacatggtgaaaccccgtctctactaaaaatacaaaaattgggattccattccaagatggccaaatagaaacagctccggtctacagctcccagcgtgatcaacacagaaaacgggtgatttctgcatttccaactgaggtatcttgttcatctaattgggactggttggacagtgggtgcagcccacagagggcaagccgaaacagggcagggcattgcctcacctgggaagtgtcagaggatttccctttcctagccaaggaagctgtgacagactgtacctggaaaactgggacactctcgcccacatactgcacttttccaatggtcttagcaaagagcacaccaggagattatatcctgcacctggctcggcagttcccactcccacagagccttgctcactgctagcacagcagtctgagattgaactgtgaggcagcagcctggctgggggggtgggcatccaacattgctgaggcttgagtaggtaaacaatgtggccagggaagctcgaactgggcagagcccactgcagctcagcaaggcctactgcctctgtagattccacctctgggggcagggtatagctgaacaaaaggcagcagaaacttctgcagacttaaacgtccctgtctgacagctctgaagagagcagtggtgctcccagcatggtgtttgaggtcttagaatggacagactgcctcctcaagtgggtccctgacccccttgtagcctaactgggagacacctcccagtaggggccaactgacaactcatacaggtggtgcccctctgggacaaagcttccagaggaaggatcaggcagcaatatttgctgttctgcaatatttgctgttctgcagcctccactggtgatatccaggcaaacagggtctggagtggacctccagcaaactccaacagacctgcaggtgagggatctgactgtcagaaggaaaactaacaaacagaaaggaatagcatcaacatcaacaaaaaggacatctacaccaaaactccatctgtaggtcaccagcatcaaagacaaaaggtaggtaaaaccacaaagatggagagaaaccagagcagaaaagctgaaaattctaaaaaccagagtgcctcttctcctccaaagggttgcagctcctcacgagcaacggaagaaagctggatggagaatgactttgacgagctgacagaagtaggcttcagaaggtcggtaataacaaacttctccgagctaaaggaaatgttcaaacccatcgcaaggacgctaaaaaccttgaaaaaagattagacgaacagctaactagaataaatagtgtagagaagaccttaaatgacctgacggagctgaaaaccacagcataagagctacgtgatgcatgcccaagcttcaatagccgattcaatcaagtggaagaaagggtatcagtgattgaagatcaaatgaatgaaataaagtgataagagaagtttagagaaaaaagagtaaaaagaaatgaacaaagcctccaagagatatgggactatgtgaaaagaccaaatctacatctgattggtgtacctgaaagtgacagggagaatggaaccaagttggaaaacactcatcaggatattatccaggagaacttccccaacctagcaaggcaggccaacattcaaattcaggaaatatagagaaagccacaaagatactcctcgagaagacacataattgtcagattcaccaaagttgaaatgaaggaaaaaatgttaagggcagccagagagaaaggtcgggttacccacaaagggaagcccatcagactaacagtggatctctcggcagaaactctacaagccagaagagagtgggggccaatgttcaacattcttaaagaaaagaattttcaatccagaatttcatatccagccatactaagcttcacaagtgaaggagaaataaaatcctttacagacaagcaaatgctgagagattttgtcaccaccaggcctgccctacgagagctcctggaggaagcactaaacatggaaaggaacaaccagtaccagccactgcaaaaacatgccaaattgtaaagaccatcgatgctaggaagaaactgcatcaactaacgagcaaaataaccagctaacatcataatgacaggatcaaattcacacctaacaatattaaccttaaatgtaaatgggttaactgccctgattaaaagacacagactggcaaattggatagagtcaagacccaacagtgtgctgtattcaggagacccatctcatgtgcagagacacatgtaggctcaaaataaagggatggaggaagatctaccaagcaaatggaaagcaaaaaaaaagcagaggttacaatcctagtctctgataaaacagactttaaaccaacagagatcaaaagagagaaagaaggccgttacataatggtaaagggatcaattcaacaagaagacctaactatcctaaatatatatgcacccaatacaggagcacccagattcataaagggagtccttagagacctacaaagagacttagacttccacacaataataatgggagactttaacaccccactgtcaatattagacagatcaacgagacagaaggttaacaaggatatccagtacttgaattcagctctgcaccaagtggacctaatagacatctacagaactctccaccccaaatcaacagaatatacattcttctcagcaccacatcacacttattcaaaaattgaccacatagttggaagtaaagcactcctcagcaaatgtaaaagaacagaaatcacaacaaactgtctctcagaccacagtgcaatcaaattagaactcaggattaagaaactcactcaaaactgctcaactacatggaaactgaacaacctgctcctgaatgactactgggtaaataacgaaatgaaggcagaaataaatatgttctttgaaaccaatgagaacaaagacacaacataccagaatctctgggacacatttaaaacagtgtgtagagggaaatttatagcactaaatgcccacagaagaaagcaggaaatatctaaaatcaacaccctaacatcacaatgaaaagaactagagaagcaagagcaaacacattcaaaagctagcagaaggcaagaaataactaagatcagggcagagctgaaggagatagagacacaaaaaacccttcaaaaaaatcaatgaatccaggagttggttttttgaaaagatcaacaaaattgataggccgctaacaacactaataaagaagaaaagagagaagaatcaaatagatgcaataaaaaatgataaaggggatatcaccaccaatcccacagaaatacaaactaccatgagagaatactataaacacctctatgcaaatgaactagaaaatctagaagaaatggataaatttctggacacatacaccctcccaagactaaaccaggaagaaattgaacctctgaatagaccaataacaggctctgaaattgaggcaataattaatagcctaccaaccaaaaaaagtccaggaccagatggattcacagccaaattctaccagaggtacaaagaggagctggtaccattacttctgaaactattccaatcaatagaaaaagagggaatcctccctaactcattttatgaggccaacatcatcctgataccaaagcctggcagagacacaacaaaaaaagagaattttagatcaatatccctgatgaacatcagtgcaaaaatcctcaataaaatactggcaaaccaaatccagcagcacatcgaaaagcttatccatcatggtcaagttggcttcatccctgggatgcaaggctggttcaacatatgcaaatcagtaaacataatccatcacataaacagaaccatcaacaaaaaccacatgattatctcaatagatgcagaaaaggcctttgataaaattcagcagcccttcatgctaaaaactctcaataaactaggtattgatgggacgtatctcaaaataataagagctatttatgacaaactcacagccaatatcatactgaatgggcaaaaactggaagcattccctttgaaaactggcacaagacagggatgctctctttcaccactcctattcaacatagtgttggaagttctggtcagggcaatcaggcaagagaaagaaagaaagggttttcaattaggaaaagaggaagtcgaattgtccctgtttgcagatgacatgattgtatatttagaaaaccccatcgtctcagcccaaaatctccttaagctgataagcaacttcagcaaagtctcaggatacaaaatcaatgtgcaaaaatcacaagcattcctgtacaccaataacagacaaacagacagccaaatcatgagtgaactcccattcacaattgctacaaagagaataaaatacctaggaatccaacttacaagggatgtgaaggacctcttcaaggagaactacaaaccactgctcaacgaaataaaatgacacaaacaaatggaagaacattccatgctcatggataggaagaatcaatattgtgaaaatggccatactgcccaaggtaatttatagattcaatgtcatctccatcaagctaccaatgactttcttcacagaattgggaaaaacgactttaaagttcatatggaaccaaaaaagagcccagattgccaggtcaatcctaagcaaaaagaacaaagccggaggcaccatgctacctgacttcaaactatactacaaggctacagtaaccaaaacagcatggtactcataccaaaacagagatatagaccaatggaacagaacagaggcctcagaaataacaccatacatctaccaccatctgatctttgacaaacctgacaaaaaccagaaatggggaaaagattccctatttaataaatggtgctgggaaaactggctagtcatatgtagaaagttgaaactggatcccttccttacactttatacaaaattaattcaagatggattaaagacttacatgttagacctaaaccataaaaaccctagaagaaaacctaggcaataccattcaggacataggcatgggcaaggacttcatgactaaaacaacaaaagcaatggcaacaaaagccaaaatagacaaatgggatctaattaaactaaagagcttctgcacagcaaaagaaactaccatcagagtgaacaggcaacctacagaatgggagaaaatttttgcagtgtacccatctgacaaagggctaatatccaaaatctacaaagaacataaacaaatttacaagaaaaaaacaaacaaccccatcaaaaagtgggcaaaggatatgaacagacacttctcaaaagaagacatttatgcagccaaaagacacatgaaaaaatgctcaccatcactggccatcagagaaatgcaaatcaaaaccacactgagataccatctcacaccagttagaatggcgatcattaaaaagtcaggaaacaacagatcctggagaggatgtggagaaataggaacacttttacactgttggcgggagtgtaaactagttcaaccattgtggaagacagtgtggcaattcctcaaggatctagagctagcaataccatttgacccagtaatcccattactgggtatatacccaaagcattataaatcatgctgctatcaagacatatgcacactattcacaatagcaaagacttggaaccaacccaaatgtccatcaatgatagactggattaagaaaacctggcacatagacaccatggaatactatgcagccataaaaaatgataagttaatgtcctttgcagggacatggatgaagctggaaaccatcattctgagcaaactatcacaaggacagaaaaccaaacactgcatgttctcactcataggtggtaattgaacaatgagaacacttggacacagggtgggggacatcacacaccgggcctgttgtggggtggggggttgggggagggatagcattgggagagatacctaatgtaaatgacgggttgatggatgcagcgggccagcatggcacatgtatacctatgtaacgagcctgcatgttgtgcacatgtaccctagaacttaaagtataataaaaataaataaataaataaataaataaataaaataaaatcaggagaaaaaaaattggccagtcatggtggcaggtgcctgtaattccagctactcaggaggccgagacaggaaaatcgtttaagaccaggaggcagagattttagtgagctgaaattgtgctgctgcactccagcttcggcaacagagtgagactctgtctcaaaaaaaaaaaaaaatgcacatgccctttatatgtaaattttcattttagggaataagttcacatcttcttaacatatattattttggtgtttttagacaattccagttcaaaattcctctccaggtacatttacctgaagaaatctgcatctctggtctaatgcaagatctggtttccaggctgggcgcagtgactctcgcctataatcccagcactttgggaggccgagatgggaggattgcttgagcccaggagtttgagaccagcctgggcaacatagtgagattatgtaaaaatacaaaaattatccatggactagtgggtgcctgtagtcccagctattcgggaggctgaagcaggaggatcactcgagcctggaagtcgaggctgcagtgagctgtgatcaccataattttactccagcctgggtaacagagagacaaccagtctcataaacaaaacaaaacaaaatctggtttctagagtttatagaatcatacaacagcatgtttcatggagcgttccatctcacaaggtggtgtttggtttagagagggttatgtatgccctctgatattctcaaatctttatttaaaatgctgggagagttgctatctggctttgcatcagtgtttaatataatagccatccttttggggtgggtgttgacgaacagcacacctgccatcttccaaattataccccacactttgtcttgttgaatattattaagatataaagacagggaagaccttccatttccctcccacgtccccaccacctttagttgggagcacagatgtccctgaggcactgctatagaccatgaggtcaccgcaacacaagggacatcaaatgggattgctctggctcaaaacagccagtcttaattctggtgcgatgaatggctttggtggtcgtcccagataagaacattcagcgtcagcaagaaaggctgtaggtatttggctgaatgtaatgttttgttgttgatgtgctgttgtttttcttttcctgggtgtgtagtaggagttgcaaatgcgggctgcagattagcaacgggaaccatctgggtgagcctagcagggaccagccctcccatgggagagagaggtgacacggagcagctgatgctttcgtaatgattcgaggcagctgccaaaagaggcagagcctttgcagaacagcctgtctgttctgctcctagacattagagagataatacggctgataggtgagttggggaaggcttgtttggacacattttctcagccttttttttttttttttaacctctggtagaaacgggcatagttgaaagatccattgacctattgtattctgaaactcaatggatcatcagcttaggcactgagaaatggattccaaaccaattttagtgtgagcaagtttctctcctttctgttactctcataccctttcttctttcttccctccctccctcccttcctttttctttcttaaccaagaacgtgtgtgtgtgtgtgtgtgagtgtgcgtgcgtgtgtgtctgtgtagtgtgtatagtatgtgtccagagtatacatgctttggaacaaaatgaatttaaggaggaatgcgtttgtattttgtccttagtgttattttaaggtacaaatatgggtaataacttgcagactacagatgggcttttctttcattgtaatgcatttggctgtcatatcccttagtcctaacccctctgccactgccaactaaatataaccattagtcattcagtggtttctgcattttgcagtcaaaaaagagggagctcattttgattaattgcctctttccttattcaggacacagaagctttctgagtttaaacttttaggcttggcaggacattgagacaatgctcttgggccagcatgtttcagggcaggttttgccactgagacaattcatccaagagccccaggacttggggcagcaggagttcttttaaaaatgggccaaaagacgggcagagcacttgaggtcagcagttcaggaccagcctggccaacatgctgaaaccccatctctactaaaaatacaagaattagccgggcgtggtggtgcacgcctgtagtccccactactcaggaggctgaggcaggagaatggcttgaacccgggaggcagaggttgcagtgagctgaggttgcaccactgcactccagcctgggtgacagcgagactccggctcaaaaaaaaaaaaaaggtcaaaagaatgaactcattgaaagttcaggatttgtgcagtagtggccttggaaaatcaatttaaaaatgtcggaattagggatatggctcacaagtctagtgtgaatttcatgctgggaactaatttaattgacacatgaatgatactttttttttttttttttggtcttttaaatcacgtctgtgtcttctgccaaagacaacaagaaggtattccaagctgcacaatgaggcccaggtaggtaaagccatatactgcattgtgagcacattgaatctaatgtataattctgtgtatttgtgaatccagccttataggtagaggcatttaatatcatctgcctttttttcttttttctttttcttttcttgtaacctactatgagtcaacatgctgtctttatatggctggccataagatgtctaagttcattctctcgacttagtaagtgtgtaagttttttaaaaaggtaggagttaggcaattgatagagatgtaaactgtaaatttccaacagatacatatgagtttatgtttatttttatttattttagagacagggtttcacagggttttgctctgtcacccagggtagacgacagtggtgcagtcatagctcactgcaacctccaactcctgggctcaagagatcctccagcctcagcctccagagtagctgggacctcaggtgcttatcgccacgcccagctaattttttatttttattttttgtagagacaggttctcattttgttgcccaggttggtcttgaactcctgggctcaaggaatccccccgcctcagcctctcaaagtgctgggattacaggtgtgagccaccattgtgcccagccgtatacatgattttaaagtgttgtaaaaacaggaggtgaaaaaattcaactaactttgcatagatgaaaagcatttctataacttcggggatttggcccacagtcctgagcatgtagcttttgcctgcaagacattctcaatcttcaaggagatgtttgcatacagcaaaaaaattgtactcttctgtggctgtcattgtttcagagtatttacaaaggactctgagagccaatagggatgaactcctgtttgtattttttctctcagaggagatatttgaagtgggttttgaaacatgtatagacatgagataggaattgaatcaataatccacatgtccaatattcattacctgataactgagtagggatatgctgagaagagcgtcatgtgtttccttaagaaaatatgacctcagctgggactgagcaaaactatgaagtggactcaggtggtcctcagagtccacgtttctttcttttcctcaattcagttctttccccaacttccacttttcctttacttggtaattccttattttattttatttatttatttttttgcttgtttttcttttctccagccaaagctgctattctcacactttttcttcttttgagggtctcgtcctgtagcccaggctagagtgcagtggcgcaatctcagctcactgcaggcttgaactcctgagctcaagcgatcctcccacctcagcctccagagtagctgggactacaggcatgcaccaccacacccagttcatttttacatttttttgtagggatggggtctcactatgttacccaggctggtgacgaactgattctcctgcctcagccccccaaagagctgggattacaggtgtgagccactgcaacctgactttttaaaaatttggagtaatgataaattgcatgtatttattctttttatattatgaatattttatttttatttattttttctttctttttaaattcatttttctttttatttttttcctttttaaatttctttttctttttttattgtcccttgagtcaaaaaagctgacatataaacattgcatagatttatggtgtacaacttgatgttttgaaatacgcctgcattttggaatagctcaattatgctaatgcatgttacctcatccacttacctatttgtgatgagaacactttgagtagattttatcagtaattttcaactctaaaatacattcttattaactacagtcagcacaagtacaatagattctttgaacttatttctcctgtcaaattgaaattttgtatccttcgaccaacatctccccaacccctccactggccccccagctcccagcaggcatcattctaccctttccttctatgagatcaactttttgagatttcacatagaagtgagatcatgtggtattggtgtttctgtgccaggcttattttccttagcataatgacctccaggttcatccacgttgttgtaaatgacagaatttcattcttttttaacgctgaataatattccacggtgtatatgtaccgcattttctttatccattcatgcaatgatggacactgaggttgatttcacagtttggccattgtgaatagtactgtaaggatcacacacacccacatgcccttaaattagaataaaaattctaattttagaatgaagttaaggttaaatcccttacctgtagagactcatttaagtcccttaaatgaggttaagtccctggaagagggagttaacctcaggagtcttatcgtctccgtcctctgcaatgatttgcccctgagtacgtgttttcagacttccctcctggaagggcatctactttagccttttaaaaaaaattcaatagtttttggggagcaggtgatgtttgattacatggataagttctttagtggtgatttgtgagattttgatgcacccatcccctgagcagtgtacactgcacacaatgtgcggtctttgatccctcactcccctcccaccctttccctgagtccccaaagtccattgcgtcattcttatgcctttgcagcctcatagcttagctcccacttatgagtgagaacatacaatgtttggttttccattcctgagttacttcacttagaataattgtctccaactccatccaggttgctgcaaatgacattattttgttcctttttatggctgagtagtattccatggtgtgtgtgtgtgtgtgtgtgtgtgtgtgtgtgtatgaatatgaaaatttgatatggatagatagatacctgcagatctatacagataaagaagatgtgttatatataggtatctacagatctatagatatcaagagtgtctcgctccaagcaccaagcactgctgctgaatggcagcagaagtgcccaaagaaatgcgctcttggcttctcactttgtatacaatctatagctatctatctctatatatcacattttctttatccactcattgattgatgggtatttgggctggttccacatttttgcaactgcaaattgtgctgctgtaaacatgcgtgtgcaagtgtcttttgttgttgttgttgttgttgttgttgtttttgatggaacctcggtccgtcacccaggctggagtgcagtggcacaatcttggctcactgcaacctccgcctcccgggttcaagtgattctcctgcctcagcccccctagcagctgggattacaggagtgtgccactacactcggctaatttttgtacttttagtagacacagagtttcaccatgttggccaggctggtctcgagctcctgacctcaggtgatccacctgcctcggcctcccaaagtgctgagattacaggtgtgagccaccacacccggccgcaagtgtcttttatatataatgccttcttttcctctgggtagatacccaggagtgggattgctggatcaaatagtagatctacttttagttctttaaggaatctccatactgttttccacagcgcttgtacattcccactaacagtataaaaggattcccttttcactgcatccatgttaacatctgttgttttagcctttattttatgcaaagtgagaagccaataacgcattacgttgggcacttccgctaccattcagcagcagtgctcggtgcttggagagagacactcttgagcttcaggagatgcctgggagatccacgtgatctccaaagacccctgttgtgttgtgttgggaggtggatcctgaatccacccagagaagcctgataccaataaaatccctgcttgctttccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggtaaggcggtttcatggccagtcatacgttcgtcagtcgttcaggttcagcaggctggctgtacggctgcatctatgtgcaaaaccaaatgtatttgttgggacttttttttaagttactttaaactttttgatagttttaaattatttagattatgtaatagttttacaattacatttttaataattttaatttgaatctctttcagtttttaaacttaagaaataataattgtccatcttcacagggtacacagtgaggtttggatacatacaaagtatagtgatcagatcagggtaatcagcacatccagtgcctctagcattaaccaggatggtcatagtaaaagcatggctatctggacccgagtcctggctctgcatttactagctctgaagtcttagagaagtcgctgaacctctctgtgcctgttttcttatttgtcgaatgcagagaaggctttatatccctgagtttatgtgtgtaaagaacttagaatagtacctaacacacaactaccctctatcatacagcctattatgaagcatgatgattgtatgtacatgtacatatacagatatgaacatataaatgtcattatataaatatatgtgatatattcatatatgaatatattctataatatataaagtatatatcatacatttattatattacatatccatatattatgaatatatgaacatacattcaatgtataaacatatatgaatatatttataatatatgaatatataatattactaatatatatgaatatgttattcatatatacatgaacatatacatatttctatgtctatgaatatatattcacttttatataaatgtatttttaaaaattaaatataaatatatttaaataaatatataaacatatatttatatattttataaaagtacatttaaataaatatatgtaaatatatattcattttatataaataaatatttatataaaatgaatatatcttcatacatattgataatatataaaagtatatattatcaatatatattgataatatataaatatatatttatatatataatatataatattcataataggctgtatgatagagggtagttgtgtgttaggtactattctaagttctttacacacataaactcagggatataaaggcttctctgcatttgacaaataagaaaacaggcacagagaggttcagcgacttctccaagacttcagagctagtaaatgcagagccaggactcgggtccagatagccatgcttttactatgaccatcctggttaatgctagaggcactggatgtgctgattaccctgatctgatcactatactatatattaataaataaatatatattatttattaatatatatttaattatacatatataaatattttaatataaataaatataatataaatatttataaatatatttataaataaaattatatataattataaatatataattaaatatataattaataaatatatattataaatatagatttataatatataaatatatattaataaatatgtatgaatttatgaatatatattcaattatatatattcataaatatataaatgtgaatatgtatattcagcagaattcattctgtttcctaatttggtgagccaatagattctttaagatggtgagcttgtatttttaacaatgggcattctgaaagaagaaaaacagatatgaaacaaactcagtgctttgtggtggataatagaagctatctgtattagccattcttatactgagcttaggagtacatcgttatcagacgtacatcatacacttttaagatcattgcgttgtatgactaatagatgctgaaggtagtcatcacagttttcgacaacggagctaggagtcatgaaaaagtagtcgccaaaaattaaccattgcttatgagaaaagaagagaggactcaccgaaaagcgcagaaacatggtgtccataaatggcagatatttacagagagtatgttagcgtggggtatcggtgttttgctgaaaatactagcaatttgagaagtgagattataatgtgaaatctaaaaccaggcacatgtgccccaggaatgcagtttacaatttttttctttgcaaaataaataatgttttaaaagttggtaggtgacttccatatctgaaaaaaaaatcagatgcacaccttggtaaagctggaacttctccttgcaccagttacctgtcataatttctctcatgaataaatgtagaactcattatattttattttcatccaagaggagactgattctttttccagaagtctctccagcctccagaaatctcttgttaaattattttttaattgacgaattatagttctgtgtatttctggtgtacatcatgatgttttgattcatggatccattgtggaatagctaaatcaagctaattaacatgcacaaccacacatacttattatttatatgtggtgaaaatggtgaaaattatagcaatttcaagaatagaatacattgttattaactatagtcaccacaatctgcaacagatctcttaaatttattcctctatgtgaggaataaatcaaatagaggatttattcacgtttggctccgtgaaatgttgtatcctttaacctacctgttctcgaccctcaccccagcgcctgatacccaccattctactgtctacttctgagtttgctattttagattccacacataagtgagatcatgcggtatttgtctctctgtgcttggcttatttcatttaatctaatacccttccagttcatctgtgttgtcgaaaatggtgggatttccttcttttgaatatttaatcatatgacagttttgcaacctatgcagactgcagggaaatgtatctatcaaaccagtgagtgggtgggtctgtgagtagttaggcataagtaaggtctgtaagcaattagcctcgatgaatcagaccccaatcccttaagcattttattttgtaaggctgaagtacagtgaatggacaccatatagtggcacccaggtatatgaaccctgcagaacaacagctgcctggaatctcagtcatacttcaccttgacacgggcaaaaaagaaaaatgaactccgtgtgcagttacctgctctgggtacctggaaatcataataaacagagatgttgtttatcttcagatctctctgtctctctctctgtctctctctctcctctttctgtctctacatctctttctatgcctatgcgtgtctctgtcacccctctctgtctgcttgtctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctctgattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctctgtatctctctctgtgtctctttctctcttttcatctctccctgtttgtctctctctgtttttctttctgtctccctccatctgtctctttttccacctctctttctgtttctctctgtctccctccctctgtttatctctctttccatttctttctgtctctctcttaatctctgcatgtctctttccatctctctctttctgtttctctctctctgtctttctctctctctcttgtcttctctctgtccctctctgtctttctctgtctccctctttctgtctttctctctccttttttctgtttgtctctctctttccatctctctctgtttctctctgtgtgtcttaccctttgtctctttctctgtctcttttcatctctctctttctgtttttctctttctatccttttctgttgctctctttctcgtttgtctctctctctctttcatcctttctttctgtctgtctctctctctgcctcgctttctgggtctctccctctctccctgtctgtctctcctctctctttccacctgtgcctttctgtttgtccttctctgtcttcctctcgctcttcctctctgcttcccccgccccccaccttttccttctctccaatacaccttccctctcccccttcaggacgcctcacatcgaccgccttgccagggaaggcgtgcgactgactcagcacatctctgccgcctccctctgcagcccaagccggtccgcgttcttgacgggaagataccccatccgatcaggtgcgcaaactggcgggctctgctgggctctgccctcatgttaggatgtgaggaaacaaaaatgtggcttgaccacgttaacaagtaaaaaagggctgggcacgatggctcacgcctgtaatcccagaacttcgggaggccaaggtgggaggattgcttgagcccaggagtttcaaaccagcctgggcaacagagcaagaccccatctccacaaaatttttttaaaataagttgagcatggtggcatgtgtctgtggtcccagctacttgggaggctgaagtgggaggatcgcctgagcccgggagtttgaggctgcagtgagtgtgatcacagcattgcactctagcctcgttgatagagcatgtgttagaaagaaaaaaaaagatacaaaggaaagaaaagaaaaagcacacatgtgcataggtgcactggcacacacagctagcactggtcacatcaaaatggctgcgcttctcagagatgcaagatcaccctgtgtgcttcagttgtcttttgatgcaatgagagttttttatctgaattccaagtcacaaggtgtacatttgagtttcccaggtcaacaaagataagctgtcttggaatgaagtaattaatacaacatgtgtttacacattcagtctgtcaccaaaaaatatctttttttttctttcaaaccacaaagtcatggccgggcatggtggctcatgcctgtaatcccagcactttgggaggccaaggcaggtggatcacttgaggtcaggagttcgagcccagcctggccaacacggtgaaagctcatctctactaaaaatacaaaaattagccggacatgggggcatgcacctgtagtcccagctactcaggaggctgaggcaggagaatcgcttgaacccgggaggcagaggttgcagtgagccaagattgtgccactgcattccagcctgggtgacagagcgagactctgtctcaaaacaaacaaacagcaacaacaaccaaaaacccacaaagtcataaaccaagaaatagctatcagatttttggacaactttcatcacagcattttacccatggagacagtagtattatccccttgctcaatttatatcaattttattttatttattattattattattattattattatttttgaaatggagtctcgctctgttacccaggctggagttcagtggtgcaatctcggctcattgcaacctctgcctcctgggttcaagtgattctactgcctcagcctcctgggtaactgggattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatggagtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaagccatcttccctctttggcctccaaaagttctgggattacaggcatgagcaactgcacccaacctggtgactttttttgtttgtttggttttttgcttttgagatagggtctccctttgttgcccaggctgaagtgcagtgtcacaatctcagctcatcacagcctcaaactccagggctcaagcgattctccctcctcagcctcctgagtagctgagattacaggtacccgccaccatgcccagctaatttttgtatttttggtagagatggggtctcaccatgttaaccaggctggtcttgaattcctgagctcaagtgatcggcccacctcggcctcccaaagtgctgggattttaggcatgagccaccgtgcctggccaaaagtagctatttttaaatgtgctattcagtagcatgtagctctttcccaatattgtacaaccatcacctctatcgaattctagaacatttccatcacccacaaaggagatcttgtccccatgaagcaatcactccccattcccccttctcgcagcccccggtcaccaagaatccactttccgtctctacaaacatgtctgtcctggacatttcacataaaaggaatcatacagtatgtgacagtctgtgactggcgtctgtcaccaagcataatgttttatggtagcctgggtcagagtttcatttatttttatgttgaatactattccctcgcatggattcactacagtttctccatccattcatcaattgatgggcagtcaagatgtttctattgtttagtgattgtgaggaatacaactatgaacatacatgtacaagtttttctttgaataccagttttcaatccttttgggttcctcaggaacctcaattcttttgacattccccaggagtgaaattgttgggttgcatggttctattttttttttttttttttttcagatggagtttcactcttgttgcccaggctggagtgcaatggcgcaatctcggctcactgcaacctctgcccctgggttcaagcgattctcctgcctcagcctcctgagtagctgggattacaggcatgtaccaccacgcccagctgattttgtatttttagtagagacggggtttccccatattggtcaggctggtctcgaactcctgacttcaggtaatccccctgccttgtcctcccaaagtgctgggattacaggtgcgagtcaccacatccagtcatatagttctatttttaaaggtgagggaagtgggcttggggcatggtggctcacacctgtaatcccagcactttgggaagctgaggagggcagatcagttgaggccaggaattcaagaacagcctggccaacatggtgaaaccccatctctactaaaaatacaaaattagctgggcatggtggtacatacctgtaatcccagctactcgggaggctgagacaggagaattgcttgaactcaggaggcagaggttgcagtgagctgagatcatgccactgcactctagcctgggcagcagagtgagatttcatgtcaacaacaacaacaaaaaaaaaaaaaaaaaaaaaagagagagagagaaaaaaaaaaaagaaaaaaaaatggtgagggaagtagtcttcgcttgtgggtacagatgccgcagtttaatgccaaattatgtggattccagatagcggttcttggaggcagaataaaatcgcacgtatcaaccctactgccagtctgctgacactgactttggacgagaagaaagaaaaggtcttttttggctgagtgcagtggctcatgcctgtaatcccagcactttgggaggccaaggcgggcagatcatgaggtccggagatgcagaccatcctggccaacatgatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcactgctgcactccagcctggtgacaaagcgagacttcatctcaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcatcccctcctaaaagccctacctcctaaccattaccttgcagatgaggatttcaatgtgcaaattttgtagtgacaaaaatattccctctgtagcaacacctactcattgtacttttttccacactacatctaggtatggtttctagtggtaatagacgtgtcatccaaaatcttgcagtccccgcaggcctccctcttaatgagacaacacttgcagccttgctaaagaagcaaggatacagcacggggcttataggtaagacacaagaattggtgttagtcattgatcataaggtaatcatgtcctttgttctacccttgatttatgactttcttggaaacgctgtattttacaatgtcttatgtaaaggcgcagtggcccatgcctacaatcccagtactttgggaggccaaggtgggaggatcgctggaaaccaggagtttcagaccagcctgggcaacatagaaagaccccgtctctaaaaatataaaattagctaggcattgtggcatgtgcctatggtcccagctactccagaggctgaggtgggaggattacttgtggcaggacttcttttctttattattatttttaaaacagaggagtctcactgtgtcacccaggctggagcacagtggcacaatctcggctcactgcaacctccatctcctgggttcaagggattcttgtgcctcagcctctcaagtagctgggactacaggcgcgtgccaccacgactggctaatttttgtatttttagtagagatggggtttcatcatgttggccaggctggtcttgaactcctggcctccagtggtctgcctgccttggcctcccaaagtgctgggattatggatgtgagccaccacacctagtctgattcttcacacagctcagtgataggagatgttttaaaatgaatatattacaagaacataaaatttttctggctctgcctgcccgcatagtctctcaccgtgtatcctgtcatctgcctctttatttcactaaaaatggaccacacagattttcttctcactgccaaggatgatagaagtcctcagccacccagtagttggaactccaactactattcctgtttgggaagcctgggtttcagctggtgtgagaataacatgctgttttaaatcccttcaatttttgtaatacatctgctgttgataagagaaggcaatctccgtggggttgcaggacaggaagcctaagccagtagcactgcctctcctctacctatccccacaggcactcagaggttgatggaagcacaggcattcttgatggggccctcaccacatacaggaagctgttaatattcctagtagatacacattatcgcagcctctgagggtttgctgatcatccacatgctagcaggactcacaggcaccctttggtgatcattcaaggtgtggtacgttttactgaataagtcccttacttcgatcagttttaatgagagcccctaggatttgcagtcagccagctattcatccatccatgctggtccatcctccatgatttatctatagctatcatcggtcatctctctctctttctccatccatccatcaacccatatatctctatgcatctatccatccatctacctgtctatctatctacctgtttgtctattgatcaatccatcatctatcatttatctatcatctatgaatctatctacccatcatctatctatcatctataatctattcatccactcattcatctatcatgtatctatctatccatcatctatatctgtctatttatctagccattcattcatctatttagacatctctctatccattcacccatccacccatatatctctatccctgtctatttatctatctgtctactcacccatctatcctttcatccacctacatatacaaatatgctccatctgtcctccatcatttatttgtacgtgtcatatttattacatctatgtctctattgatatatacatacacatatgtatacatagatgcatactccataatttatttttatccatatcttacctgtctattcatccacccacaacacagatctattcatgcatctctctatctaatcacccactcatccaggtatccatctgtccacctacacacacatatatacatgctccatctatcctccatcatttatttgaatctgtcctatcctatcttatctatttatctatctatccatctatccaactactcactctatctctatcatctatttatctatctatccattcatctatcaatccatctatccatcatatctatctatctatctattcatctatcctatctatctatccacccatagatctccatccacctatctactcacctactcagccacccacctatctatccatgcatccacttacacatacatacatgccccatctatccatccatcatttatttgtatctatcatatttatcacatctatctctctattgatatatacatacacatatgtatacatagatgtatacaccataatttatttttatctatcatatcccatctgtctattcatccacccacaacacagatctatttgtgcatctatctaattagctagtcatctatcgatccatccatccacctacacacacatctatacatgctccatctatcctccgtcatttatttgaatctgtcctatcctctcctctcctctatcctatctatctatctatctatctatctatctatctatctatctatctatccatccatccatccatccaaccactcactctatctctatcatctatctgcctatctttctgtctacatattatctatcatctatctttctttctatcatctctatttatctagctagctatatctacatatgcatctgttcatctgtctatctacctatctttctgtctacatattatctatctatatatctacctacctatcatctctagctagctagctagctctatctatgtatacatctattcttccatcaactataacctgccttgtctctgtgatgtatctattcttccatcatctgtaacctgccttgtctctgcggtgtatctattcttccatcatctgtaacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtttttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggtaagcggaataattacaaattcatgtaataatgataatgatctcttttttaaaaggacctagatagatctgtagggtgattgtagtttataataatctattgtacacttctaaatagctaaaagagaataagtcaaatggctctagaataaagaaaagacaaatatttaaggtgatggacaccccaattacactgatttgaaaaaataaatcatttgtaataattctttacaaattatatgaatgtattaaattgtaacgtgtactcttaaactatgcacatctataatgcattaataaaaataataggggatgatggtattaaaaatattgagttaggaaatggaatattgctaaatggtgtaatagggttagataaaaatatgaagtgtattgaagaccagttggactcttcagttggtacctaaagcggtggtaccttgtttgggctcctgttattaaaatcatggcctctctattggctctgaaatttatatgttgtcagaccatggacgcagaccctagtaacttaaactcacaaattgtttacgttaatttacaatgcatcttgtcatcatgttaacttacaacagggaatatgtacatatacaatatgtatatactatactatatatgtatatatataatatattttataatattttttgtctggttccctgatacatatagataaatatatatatatatctggaaatcagatgaaaaaagtaagttttccattgcattatgttcctgttgttaaaaaacaaaaaaaaagctacttggggaaattaaaatcagaaggcttctctttgagcatgtgatacgtaagggctatttcatgaattggatgaggtaaatggtcaaaggtgattgttataaaaactttatgcatccagaacacaatgactggaaattttcaagggtatctatcctcttgttgttggaccttctttctttaaaaaaagcctgtaaacacattttttcatttgctttttccatattgattgaggcttaatctttaccaatagccattctaggatctggattttcaggatgtaaggtgtcttgtgtactctggtacatagctttgtcctcactctgtagcccaagtgaaggtgataaatatgtagtttggggctggcagcggtggctcagcactctgggaggccgaggagggtggatcatctgagaccagcctgaccaacatagtgaaacgccatctctactaaaaatacatattagctgggaggctgaggcaggagaatcgcttgaatccgggtggcggaggttgcagtgagctgagatcacgccattgcactccagcctgagcaacagagggagactctgtcttaaaaaaaaaaatgttgtctgggagtaataaagccatacttgctctgtagatgcaactgaatgcttggtgtcacttagagcaaatctttctgttccctggtacctttccaaatgtgcagagttctatgaatttttacagacagagcatcaatatgtgcaaattagcaccaaccactctgaaagtatatgataagcaatcctattctcttctgtctgccagttcgtcttcaaacattcccacacagttctccttaggaatttacatgagtacttgaagaacagatcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaagttctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaatgaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggatttagtgcccatcctaattccaggatgagctcatcttcagatccttaattaattacctctgcaaaggtcttgatatccaaataaggtctcattccaggttctgggctttaaaatatatggacttatatttctgggggctactattcaaactactacaattgtatccagtttcttctggaggctctaggggaggatctcttctgcctcctctagctcctggtggctccagatgccccttggctggtggttgcattactccatttccacatggcctcttcttctgtgcttgtgtctcctcttctcctatagggacaacattattggattggggactcatcctaatccagaatgatcacatcttaagtaattaaatctccagaggccccatttccaaataaggtcccattctgaggtttcaagtgaacgtgaattttgaggggtcactgttcaagacaccatgacataagtcttgtttttaaaattcattttttttatttctttatattttgatatctcaccagagcagaaatttcccaacgaatggcatttgtgctgtgtgttttcctgggtagctgaggacttatcattcatgcagatggattatcaaaattaacagcgggtcagcctagttccctgtatcctcatgtgagaacctacagggtgcaaatggcttgccaaggcattcctgtttgtactggcttatggctcgtgaaactcttgatctggctaagaaatgacttccataccactgtctcttgatgtatctcagggtgtgaccctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaaggagttctgggctggattttttaggggaatcatggagggtcttggggtcactgatgggttggggtaagagggaatggaatcatcagaatatggaaatggtatgctttggtaagtcagcttctcatagggtccttcagagaagcagacatcagcagtttccctggtatgcacaacctgaaagattattgcaaatggaaaacttaacatttcatgatgttatgttatcatcctgtaacaggatctgtgcgattctagaacaaataggtaccaaacaagtaggaatacatagatgagagggcaagctgacctcaggatcaaagctgagtatgctgcaagcttagttcattttgtttctcccgctcccttcctctctgattgattttatgaagtttatagagatggtttcagtagcattaccaaaggggttagggagcagttgaggtgctgcaggatcatggagtccattctatgcaggatggggcccttgggtggacccactctatcttctgcagcttggagaagaaggaagcaggtcatgtctatgagaagccaaaacaatagttttcacattcatagatattgaaaactcacaagtagtttcattgatgtcttctcaggcacagtaaggaaactttccttctctttttctcctttcttcacgtgcacacacctctccccaccacggacgatttcactggcaccagcaagcatggcttgtatggggataatgtggaagagatggactccatggtgggtaagtcacaggacttaagtggacagaaactaacgtgttctgataggacaggacacctgaaaactgctcttggtcaacctgtagagtgaagagaattatgcctatgggacagagtggtctgagacattaatgaggtaatagttgctagcaattgagaaagtcagcaaaaaaactatatgcatttcctctcctttctttgcatgctgtccacttatcaacttgggtctttgtctacttgactgcgtctccagtgctggccagataacaaatcaaatcttcttttcaaaaatttcaactcttgttttagattcagggagtacatgtgcaggttttttacctgggtgtattacgtgatgctgaggtttaggatatgatcaaacccttcacccggacactaagcatagcacgcaatagttagttttcaacccttcccccactccttccttcacccctctagtagtccccagtatctattgtactgatctgtgtgtccacatatacttgatgttatgctcccacttattttgtttcatttttaaaaataaattttattgtgtattttaagattcacaacgtgacgttaaaagatacgtatagatagtaaaatgattactatagtgaagcaaatagtaatcattaagtaacataatatagtaatattaagtaatagtaatatagtaagcaaatgtatctatcatctcacactgttacttttttgtgacaagatcagctaaaatctatttaacaaaagtccagctgagcacagtggcttccatctgtaatcctggcactttgggaggctgaggcaggaggatcacttgagcctaggagtttgagaccagcctggacaacatagtgagaccctgtctctacaaaaatacaaaaattagctgagtgtggtggcatgtgcctgtagtcccagctacttaggagactgaagcgggaggattgcttgagcccataaattgaggctgtagtgagccatgattgcaccactgcactccatgcactccagtctgggtgacagtagctcccacttataagtgagaacatgcagtatttggttttctatgtctgcattaatttgcataggataatgtccaccaccggcatctatgttgctgcaaaggacatgatcttgttcttttttatggctgtgtaatattccatggtgtatacgtaccacattttctttatccaatccaccattgatgggtgcctaggttgatttatgtctttgctcttgtgaatagtgctgtgatgaacatatgagtgcacatgtctttttttttttttgagacaagatctcactctgtcactcaggcagaagtgcaatgacatgatctcagctcactgaaatctctgcctcctgagctaatgcgattctcctgcctcagcctcctgagtagctggggctatctataggcacatgctactgcgcccggctaatttttgtattttttgtagaggcaaggtttttccatgttacccaggctgctcttgaactcccaagctcaggtaatatgcctgcctcagcctctcaaagtgctgggatgacaggcatgagtcactgcacccagcccacatatctttttgatagaaagagaaatcatattttcagactctttagtgacatagccaaactttatttcaggtctgttgagcaccaatatcttagttggggattgggaattaactggtaagtcagaatccagtaccctcatgaactcatcctgtagagagaacaatgtaaatgggacgtcctaggacttacatggtaaatgtattgattagcaaaatggctttaattttccaacattaatgaaagaaaaccatgagtgaaactcacatatatgcaggacacaaatttaaagtataatattttccagacacagatattgtgaaatatatgtcactaaatagaaagacgctttggaaaattaagcctggaaaaagcaaagccaatttgcatagtcttaaacacataaaaaatatgaagtatttaaaaatataaataatattcaaaccaaatacatgaacatgaatagatgtttatgtaggtataagtgtgtgtgtctgtgtctgtagtgtttgtgtacatatgtatagaaacagatgattgacagagatagatgatggatagatagatgataggtaaatagatgatagatggatagatagatgatggactgatagttgatagatgataggtagatagatagatgatggatgatagatagatgataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatagatacatacatacatacatacatacatacatacatagatacatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcgatgggatttttctggtgacattcagataatattacgcaaacggatgggtgtgttgaatctggttggacaagctgtgatatctgaaaattatattttgaaaaagcgcaactgagatgtacatgatactggtgcccagaggttttgaatgttttgtccacacagccagaatcaagcctttaggaagaataaacatctgctttaatatataattttagcaattctcaagcaaacatatatttaccctgaaattatttatcccagaagctgtaacaataccccaagtcctaagaattgttgcttttcttattagaaaagttgatttgtggccattcctggtagagatatcaccttcctgccttttataattatcataggtggccgggcgcggtggctcacgcctgtaatcccagcactttgggaggccaaggcgggtggataacgagttcaggcaatcaaaaccatcctggttaacactgtgaaaccccgtctctactaaatatacaaacacatccgtggtggcgggcgtctgtagtcccagctactcgggaggctgaggcaggagaatggcgtgaacctgggaggcagagcttgcagtggccgagatcgcgccactgcactccagcctgggcaacggagcgagactccgtctcaaaagaaaaaaaaattatcatgggtttcccacagcagtgccctgaaataatggagtctactgatagaataaacatttattttcattttttaataatttccaccttttattttagattcagggagtacgcatgcaggtttgttacctgggtatattgcatgatgccaagatttgaagtacaatagctcctgtcacccagggagcgagcatggcaaccaatagatagattttcagcccttgtcccccaccttccttctccccttttggagtccccagtgtctattgttcccatctttatgtccatgagtacccaatgtttaactcccacttatgagaacatgtggtagttggttttctttttctgtgttaatttgcttaggacaatagcctccagctgtatccatgttactgcaaaggatgtgattttgttcttttttatggctgtgtagtattccatggtgcatctgtaccacattttctttatccatgtagattggttctatgtctttgctattgtgaatagtatgataatcatgcaagtgcctgtgtctatttggtagaatgatttatttccctttgggtagacacccagtaatggcattgctgggtcagagggtagttctgttttaagttatctgagaaatctccaaagtgctttccacagtggctgagccaatttatattccaaacaatagtatataagtgttgcatcttctctgcagcctcaccagcatctgttcctcttttatttttttgacttattgggttcgtgcaaaagtaactgaggtctttgtcattgaaagtaatgatagattgatagattatagatggatacattgaaagtaatgacaaagacctcaattacttttgcaccaacctaatagtagcctttccagctggtataataaacacttttaaaagtgatacttcctatgggccatgcactgttaccagtgtattctggatgaatccccacaacatccccggagacgagtatcatcttcatcatcatgtttatctccattcacagagaaggaggcaaaagtatgtggcctttggtggctgctcctggagataagccagggttgggctccaaagctcttactccctagctcagctacctcttatgcagggcaaagaagtcatgttgaatgatgaggaaggagagctacattcttctctgaagtctccagtagccccattagactcctacagaccgtcatttcacaggagtcagaaaaactccaaaaacttcccccaacctggcttcctgcttccttcgagcccagcgagaggctttcattggagataccacccttgccccacccaggggaaaatctctgatgccgaatgagtcatgcatttctgcatgggcaagagtccatcagcttggatctgaagagcaggtttctcaagaatgcagataagaaagtaaaatgtgcaaaaatgagtaggagaaatggccttatcagcaggagatgagacaaggatgagggtcttggctgagcctgttgtacagacagttgtgagtggtggaatcccagggcaggcctgtctgtggacagcaacacagcttgggcagcaaccctggacagggcagaactgcaaaggaggctgtaaacatgtatttctatgtcatatatatatataatttatatgaaatatttgagacacatatataaaatataacttaaccctttataatatatatatttatattatttgttatacatattagtattaataatttgaaagttatcatatatatgaatatatattatgtatttctgtagcatataatttctatatttatttatttatttcagttgatgttagaaaggtacgaatcatttccatggttgtaatccctgctactttggaggctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatattataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatatatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatatatgaagtctacagtgtttctctgttgggtatatgcaccaaaattaagaccttttctttttgttaaaaataatgcatttcaagatacaatggatcaccagctactattcattatagctccaatgtcaataactaaaatatttagaaataatttttcaagcagtaaatgagtatctcgaagctgactcatgaaagaaaacttgaatacatggaaaggaagagtggattgtatacatgtattagttatttcaaagttaatattgaaggctaaggtagctctgattagagcattaattactgttctctggggagtggtcattatagaggtgatgatgaaatacacactgaataaactgataggaaataaactttccagaaacatctgatgagaaagtctttggtagaaaacatcaagaaacacttctgtgatcataagaaatgctatcaaaaagataactacaaaaattaaaacgcagaaatacaagatttgacttttagatcaatgaagcagaaaataatagccttagagcaggtctgggaaagagaaggacattacattcggtacaataaagtttttaaatcaaggtggcaggggtgaaaggtgttggggaaagtttgtgttatgagttgacttacatccccccaaaaaggtatgttcaagtcataatccaaggtatgtgagaatgggatcttatttggaaatagggtcgttgcaggtggaatcaagttaagatgaggtcattgggggtgggtcctaatccgatatggtgaattaggatgaggctgctacatgccaaggaaggctaaggactgatgccaactgtctgaagtgaggaagaggtaaggaaaggtcctcccctagaaacttcagagagagagagtgactctgccaacacattgattttgaacatctggcccccagaactgtgaaagaataaatgtttgttgttttaagccacctcatttgtactaatttgtttcagcagcccaaggaaattcacagagttagtttaggaaaaaccattaccaattcaattagcatgcttttccatacacattaaggacattgagtgaaacaaaacaaaaattggaagaagctatagttaaacagtaaatttacatctggatgaggtatagtgttagtaatagcaaaaggttatctgataagtagcatgactaaaggccctatgcaaactgaggaaatattagcaacaacatgacattgttttaactgcttgacaaataaagagttcttataaatcaataatggaaacacataattccttccaaaaatatcagcaaaattttaaacatcttttacagattaaaagtacaaatattagagtggacacaggaggaaactcatgatcattcataatgtaccataatcacctatcaaacattagatactgatgaggaattgagaaaatgaactattattaatgccaaaagttgttcattatggcattttaaattatggcaaagtatgaaaattaaccagaatagtgaacaacagtaaaatggttaaataatttatactacttaaaaataaagtatcataaattgtttaggccaggtgtggtggctcacgcctgtaatcccagcactttgggatgccgaggcaggcagatcacctgaggtcgggagttcgagaccagcctgaccaacatggagaaatcctgtctctactaaaaatacaaaattagctgggtgtggtggcgcatgcctgcagctgaggcaggagaaatgcttgaacctgcgaagcggaggttgcagtgagctgagatcgtgccattgcactccagcctgggtaacaaatgcaaaactccatctcaaaataaaatatatatatatacacatacacacacaacacacacacacacacacacacacacacacacacacacacaatggacacttttccagccattaaattgtacatataattttttaaatttatttttttaattgagacagggtctcactgtgttgacaagggtggtctcaaatacctgagctcaagggatccgccttccttgccctcccaaattgctgggattacaggtgtgagccatgatgcccagtcttgaataattttttaacacgaagattttccgagaaataatattggatgaagaaagcaagttgaaaaccgttcatacaatatcaacccaaatagagagagagagatgcatctacaagagtatgtgatatggtttggctgtgtccccacccaaatctcatcttgaattgtagctcccataattcccacatgttgtgggggggacctggtgggagataattgaatcatggaggcagtttcccccatagtgttctcatggtagtgaataagtctcatgagatctgatggttttataaggggaaactccttttgcttggctctcattctctcatgtctgccaccgtgtaagatgtgcctttcacctcccatcgtgattgtgtgtcctctccagccacgtagaactgtgattccattaaacctctttttctttataagttaccccgtctcaggtatgtctttattagcatcgtgaaaacagactaatacagtatgtaacaattttttttaaatagtcaaatggcaatggggcaggaaattggtggtctttattttcctccttataattttctttatttttttgtatttcccaagctattttgtatttttataatcagaaaaatattagctttgttgttttttcttgctacttttcactatttactgaaaagtagcaagaagagtaaaaacaactcccgtgtccccttcacccatctttcccaattgttagcaatttatcaaatatatcttctctcgcccctcttcctttctcctgatcatcctctttcttcctctctctctctttctctcttccacctccacatgtttcttatgcttctgaatatttgggaataagatgcagatatgatgttcattaaatttagaaactttagtgtgtattttctaaaacaaagacattctcctacatcatcactgcgaatcatcaaaatcgggaaattaacatgggtggattcttaggatttaattcacaaatcccagccaaacttctccagctgtcctcaaaagaaaatttatacacagcaagcaaaaccaatggacaaacaaaaaccaaccaacaaaacccctacttcctctaccctctttctgttctggtccatggattttcttgttgtatctgtttaaactcctctgatctggacaaagactgagcaatctttattctttcttgaattcaaagaccttgacattttctgagaataaagaccgggtatcatctagaatgtcccttgaattgggttggtttgacatttccttcaatggaagtggaagtgatggtgtgttctcaatccagtagacaagtaagtgaattagccccaacaatggttataaaattcttcatctcttgattaaatggtgtcttccagttttctccactgtaaagttacttattttgtcattacttaataatttgagatttttaactattttatgggagatactttgagatgaagccaatattttggttcttatcaaacatttaatgccaggtttagcatccattgatcattttctcttggatgaattttcagtgcgatttttgctaaaagtattgtggtaaatttttaaaagtattttaaaatataaattctttcttaacttgcccttacttgtgtgccttggctctagaagaaaatttctaaggtatagtactttaggaatgttaatgtaatgttatctgagataaccaacagtagaacacatagaattagacacgtttgagactaataagctttttcataattatgcataatacagactgggtttgggaactctaggaatttagctattttcctataaaaatgattggaaatgtggtttattttgaatacattcttcctcttttaacttgcccattgagtctaattctcccaacctagtcatcctattctctatttaaaatatcaaataagaagggaagggaaaatggttaaagaattacttatctaaatcatctgcaagaatatatcaaataaattatgtgaacccaacagtgggagtgtcttattcttgcctctgtctcctcaaattctgtaacaatgtctgccttctgtgagcagagaggttgcataaaccgtgactgccattctgtgcaacatcagtcagaataccactacagtccttcgtttcatatccagtgggaaaaactgtatttctctgtttaatgttttcattctgcatgaaggaaattatcaaggagaatttgtccttttaaatgataccagtagcaactgatgttcatttgtattgccataatatttttttcttaaagcaggtcatcttttatttcttaaaaattttggactctcagttttttgtttttttgttttttgtttttttgagatgagtctcactctgtcacccaggttggagtgcagtggcacgatctgagctctctgcaacctctgcctcccgggtgtaagcaattctctgcctcagccacctgagtagctgggattacaggcctgtgccaccatgcctggctaatttttgtgtttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttgtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatttatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgtatgtacaccacgttttctttatccacctgttggttgatgggtacttaggcttgttccatatctttgcaattgagaattgcactgctataagcatgcgtgcgcatgttagacattgtatgtttgcttatgggaactgtttttaaaaatttttggctcatgcctgtaatcccagcactttgggaggctgaggcaggcggatcacaaggtcaagagatcgagaccatctggccaacatggtgaaactccatctctactaaaaatacaaaaattagctgggcatagtggcggacacctgtagtcccagctactcaggaggctgaggcaggagaatggcgtgaacccaggaggcggaggttgcagtgagccgcgatagcaccactgcactccagcctggcaacagagcgagactccatctcaaaaaaaaaaaaattaacttttcagcatgccatgacataatgtagattttactctgattaacttaataaaataagagtcaattaacacaggacagtggccacttctcctaatttccccctggaaatcctggtgtatgcctgtcatcttggtataattaagacaactttctgcttttattctcaataataccttgatgtggacaataagttaccatatgtccatagtattccatttgttttcaaggtgcatgaatcaacagtgagcaaaataggcagaaatcctcgtcttcatggagtttatatcctactggagggaggcacagcagaaaataaaataaaataaataaataatatggcatattagaaggtggctgtaaataagaaaaaacacgagagtaaagaattctggggtgggactgccatttcaaataaaatgttcaggcacgcctcattgaggttactgtgagttccataaaattgggggctggatacaagaaaaatattaattaaaaaaaatataggaagttactttgagcaaaggtatgagggaggttggaaatgaagtaggtgtatatttgagataagaacactttaagtagagaaaatagccatgcaaatagaatgtaaatgtccaatattacatatgcttagttatttaatcaaaaacctaccagcagcacaggaaaatataattctgtagacgtgcactacttaccccactaggactctacatagagtagacactatacaaatgtgatctcttttgatactagcttaccttttaaatacattcaatacagtgactattttaactaggcacaataattgaacttaattgcattgtcttataggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacaggtgatgtcatataaactgttaacaagagcttattttcacccttcttccttctcagaagattcagaacaaggagactgactctatcctggcagacccactttttccctagtatctacacagttttaccttcctatatgactgtgtctattcagcatttttcagaagagaccagtcttttctttttttctattgaggtaaaatatacatatataatttaccatctttaccatttttcagtatacagttcagtggtaataaacatacttattttctttttttccccttcattttcctctcatctctcccctctggtcatcactattctactttctatcttcctaagattcactattatttatttttagctcccacactgagtgagaagatgtgatgtttgcctttctctgggcttggcttatttcacttaacataatggccaccagttccattcatgttgctgcaaatgacaggaattccttcttttttagggatgaatagtattcccttgtgcatatataacactttttaaaaagttaatttgtctgccgataggtggttaggttgattctatagcttggctattgtgaagagtgctgcgataaacatggaaatgcagctattcctttgatctgttgatttcttttcttttgggtgtataccaagtagttggatttctggatcacatggtagctctatttttggttttctgaggaacacctcaccacgcaaaacagataaagcaaattacaaccgaaaatagagatggacagatttataaccagaggtcctgaacaagtatcagagaccagtcttagatactaatctaatgcggaccatcttagatactttaacattttcaattgagagaaagatggagacaggaagctttggagatgaagacatggtaggtaaaactcactcatctctataagaaagggaaaaataatcctagtctctggtgtgaaagatctggaagactgagaagaaggtaagatatttgaggatgctttgaactctatcatgaatactttgaatttcttcaagaggagatcgttcatactacattgctccattccctggcagcaaccagcctaggtaggtttgctgctgattgacagttcattgatcacagctctgcaagggaatccagatgggttagaaccgcagctatgtctctcctccaagcccacagagttcttgtaatatttctttcttcacgtaacaaagctaatctatttctgaagaaataggttctgttggcactaatacagaaaagaaaaatattttagaagtcatggttaacttactgaaaaacaaactatcaagaactaatcaagacacatccccaagtttgcctttctaatatttaaaaatttatgtttgatgctagcagatatctctatcaacacactaaggctggaatttattttataattttcgggactgaactttagatgaagacatttttattttctgcctggaaagaagttagtcattgatgatgctaacacaggaaagaaaaaatattttattctttatttttatttattttatttttgagacagagtttcgttctgttgcccaggctggagtgcagtggcacgatctcagctcactgcaacctctgcctcccgggttcaagtaattctcctgcctcagcctctccagtagctgggactacaggcaccggccaccacgcctgggtaatttttgtatgtcttgtagagatgggttttcgccatgttggccaggctggtcttgaactcctgacctcaagtgatcctccctcctcaacctcccaaagtgttgggatttacaggtgtgagccatcatgaccagcccagaaaaaatatttaaaaaaccactgtgaagttattgcaaaaagaacctatcaaaaaactatggagaagcccagctttcctgttctaccatttagaaatagttgttttaagaagtctgtcgttccacatagcccaacagcctgttagggagacggcaaatgtccaggcacaatattgttacgttgcatgagggtggaaggcaactgctgccaagttccagccgttgtcctcacgttaaaaagaagaacgagttgattggagtcactcatcactccagtgcattcggcgccatgagattacatgctcatttggtcaggggtttagggttatgagtttggtgtccttgataagatgtatagtacagctgtcctttcctgcctgcaaccatgactccactagccataggctaagtcttcagaggacgcaccatctttgtagttcaacgggaagtggaagaatatcgcgaagatgactaaggcactgtggtgggagacctaacctcagcttcacgtacaggtcggcgtgccgggtactactcatcaggttgattttttggttattcctatgcttggttctcccaagcctctttatttgaattcatgacttctttggcatgtgcattgaccagttaaatatgtccttgctaatagagaatagctgtactacgtagaagggaacaaacagcaaattcacagtatcaggctcactgtctatgacaccagcatcatgagggcctgtggatacctctctcctgtctgcttcaatccccaacacaatgaaatcaacaagaagaactcaaaagcggctctcacctgtacagaaatgaaggctgctaatactgtaaaagccaaatagttatttatttttagaattaacacaatttgtttcaccacctcatcacacaaaacagataaagcaaattacaaccaaaaatagagatggacagatttataaccagagatcctgaacaagagtgtagaatagacaaaaaagaaaagtaaagataaaacagaggacaccattaatgtgtagaaacacgggaatctgaggatgcaatggtttatcaaagtgttgggaaaaaatgacttatcaggtatgtggtttaccaatacagctgtcccttggtatccatggggggttggtctcaagacctcacgtggataccaaaatacccagatgctcccgtccctgatgtaaaatactgtagtatttgcatattacctacacacatccttttgtatatattaaatcatctctagattactcataatacctaatacaatgtatgtaaatgccacataaaatagttgttatattgtaccctttagggaataatgacgagaaaaagtctgtacatattcagtacaaacaagaccgtccctaaaaggaccataagcctaaatgtaaacccaaaattataacacttctaaataaaacataggagaaaatcattgtaatattcagataagaaaataatttttttagatttatcaaaaaagttgcaagctataaaagaaaaaagtgatagattagtcattatcaaaatttaaaatttctgcttttcaaatgtcaatatcaagtaaataaacatgtgacctcagtccattagtggagaaaaaaagaaaagaaagaaaaaattaaaatattaaatatgaacttaaaagaaagtttaaaagaaaagaaaaagacaagccgtggagtagaagcaaatagtcatccctctgaactcagaggttctgcatctgcgaattcaatcaactgcagatcaaaagtatttcataagattttctagaataaagaatctagaatagcctaaaattttttgaagaagaaaatcatttgaagactcactacataattccaaaatttactataaagctagagtaatcaagtttaaaagagtaatcaggatggtgttctaatgctctaaatttttaaaattgatatttaatattttaatttttttctttttttctttttccccactaatggagtgaggtcacatgtttattttcttgacattgccatttgaaaagcagaagttttacattttgataatggctaatttatctttttttcttttataacttgtgatttttgtgataaaacttaaaaaaaattttcttatcaaaagatcacagtgattttctcctatgttttcacttagaagttttatagttttgggtttacatttaggcttatggtccacattgagttaattttttaatgtggcttgaggtataggctgagatttattttccttgcatttggatatccaatttgtctactgtcatttattgaaagacagtcctatctctactgaattattttgagcatttgttgaaaagcagtatacgtgttggtcaattcctggactctcctatttcattgatccattgaaacccttatttcaacactacactgtctcaattagtctagctttatagtaaatctgggagttatgtagtgagtcttcaaactattttcttcttcaaaaaattttaaaccattctaggatctttattttcccatgtaaattttggaataagtttcttcctttcaacataaacctttctgaaattgtgattgagattgctttaaatctatagatcaatttgcagaaaattgatgtcttaaaaaactttgaattttccaatcaataaatatagttcatttctccatttatttctcttatttggtgctttgtggcttttctcatacaaatttttcacataaaaatgctatccctaaatacttcatgctttctcatgttatagtacatgatactttaaaaagctattcccagctattcattgcaaatatatagacatttttaaaagttgttattgtattgtgtgatcttgctagtcttactcattatttccggcagttttttcagtgataattaacataggaaatcattgtatctgatagtaaatatagttttatttcttttaagatcctttttaggcatggcacggtggctcacacctgtattcccagcactttgggaggccaaggcagataggtcacctgaggtcaggagtttgagaccagcctgaccaacatggtgaaaccccgtctctactgaaaatacaaaattagccaggcatggtggcacacgcctgtaatcgcagctactcaggaggctgaggcaggagaattgcttgaacctgggagatggaggttgcattgagccgagatcgtgccgttgcactccagcctgggcaacaagagcaaaactctgtctccaagaaagaaaaaaaaatcctggctgggcgcggtggctcacgcttataatcccagcactttgagaggccgaggtgggtggatcccctgaggttgggagttcaagaccagcctgactgacatggagaaaccccatctctactaaaaatacaaaattagctgggtgtggcggcacatgcttgtaatcccagctacttggaaggctgagacaggagaatcccttgaacccgggaagcagaggttgcggtgagcagagatcacaccactgcccctcagcctgggaaacaagagtgaaactccatctcaaaaaaaataaaagagaaaaatccttatctgggatgtattattatgtgtcccattacaaagcaggttttattattattgctttctaatacaaggcataagatatattttctaatataaatttttaaaattcattttagtttagattcagggtcccatgtgcaggtttgttatttggatatattgtgtgatgctgaggtttctattaaattcatcacccaagcagtgaacatagcgcccaacgggtagtttttcaacccttccctcctccctccctcctgcttttcggagccccccagtgtctaatgttcccatcttcatgttcatgtgtacccagtgtttagctcccatttgtaagtgagaacatggtgattggttttctgtttgtgcgttcatttactccatttctcatataaaattagaagtatatgactttttagtgattacataaaattttttcaaagggtagcaatataattgcaaatgaagttcagatttatgaaattgccataaattgctgagctgtggagagctctgtgtcgcagccaaggctgtctgatcttttcgcctttggggcatgcattgtcacattcctcggcctcatcatttcaggatcagaacttagctttcttctcttgtccactggagtgtaatctcccagagagcatgcatgagttttcctaaagactcagtacgctgtcctctggacctgaggcatgacgcagtcttcaccaagtacccttcaggtagcttgggacccaacgtcccttctcctcattttccttatctgcactgtctgtgtctctgcagggtcattgacggccgagacctcatgcccttgctgcagggcaacgtcaggcactcggagcatgaatttcttttccactactgtggctcctacctgcacgccgtgcggtggatccccaaggacgacagtgagtgctcaacccgttgcttcctgttccctgccaggagcagggtcactcaggtgtatcctgaacgcattcttcctttcctctctagaccggtcctttcattccagggctcactgaacacatggttttggagaagtttctcagaattgctcttctgcagaaaggcaggtgggggtaatggagatgctaattggcttcacttaattatctcagcagtcgcacatacattaaaacatcacattgtgcatggaaaatctatgcaatttttacttatcgattacactttaataaagaaaacagatgtatgaacataagatttgcctataaagttagagagacacttttacgaaacatacatttttagtcaggtgtggtggatcacgcctgtaatcccagaactttgggaggccgaggcgggcagatcacttgaggtcaggaatttgagaccagcctggcaaacatggcaaagccctgtctctactaagaaatacaaaaattagccaggcatggtggtgcacacctgtagtcccagctacttgggaggctgaggcggtagaatcacttgaacccaggaggcagaggttgcagtgagctgagatcacaccattgcactccagcctggaagacagagtgagactccatctcaaacaaaaacaaaaccaaaaaatatatatacatttttagaaacaggactgatatctgctggaaaatgtgtatatcatttcaccagggaactctaatgttctcgttttgttgtaaggattgcataatatttagcattgacgtgtgggcaaaaagaagcccaagaaccagccttgagaagacggaagaagacaagagaagccagcaccttgggtgcatgcctctgatgtgctttctttctttcttttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataattggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcatcatgtagaatcagtgggagccctgagcttgctttcctgcaactagatggtcccatctgggggtgatgggagacagtgacagatcatcaggcattagattctcatacgtagcctgcaacccagatccctcgcatgcacagttcacaataggtctcgtgctcttatgagaatctgatgcagccactgatatctgacaggaggaagagctcaggcaataatgccaacgatagggaatggctgtaaatacagagataaagcttcgctctctcccccaaccactcacctcctgtgtgtgaccaggttcttaacaggccacgaacaggtaccagtttgtggcctggggactggggacccctgctatagaacactaggacttcttcctttgatctggctgaagtgcgcatcatttgacgagtctctcttttctcctccaggtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttccact

SEQ ID NO: 1328 - DNA, 45931 bp, Homo sapiens
aaaagaggcagagcctttgcagaacagcctgtctgttctgctcctagacattagagagataatacggctgataggtgagttggggaaggcttgtttggacacattttctcagccttttttttttttttttaacctctggtagaaacgggcatagttgaaagatccattgacctattgtattctgaaactcaatggatcatcagcttaggcactgagaaatggattccaaaccaattttagtgtgagcaagtttctctcctttctgttactctcataccctttcttctttcttccctccctccctcccttcctttttctttcttaaccaagaacgtgtgtgtgtgtgtgtgtgagtgtgcgtgcgtgtgtgtctgtgtagtgtgtatagtatgtgtccagagtatacatgctttggaacaaaatgaatttaaggaggaatgcgtttgtattttgtccttagtgttattttaaggtacaaatatgggtaataacttgcagactacagatgggcttttctttcattgtaatgcatttggctgtcatatcccttagtcctaacccctctgccactgccaactaaatataaccattagtcattcagtggtttctgcattttgcagtcaaaaaagagggagctcattttgattaattgcctctttccttattcaggacacagaagctttctgagtttaaacttttaggcttggcaggacattgagacaatgctcttgggccagcatgtttcagggcaggttttgccactgagacaattcatccaagagccccaggacttggggcagcaggagttcttttaaaaatgggccaaaagacgggcagagcacttgaggtcagcagttcaggaccagcctggccaacatgctgaaaccccatctctactaaaaatacaagaattagccgggcgtggtggtgcacgcctgtagtccccactactcaggaggctgaggcaggagaatggcttgaacccgggaggcagaggttgcagtgagctgaggttgcaccactgcactccagcctgggtgacagcgagactccggctcaaaaaaaaaaaaaaggtcaaaagaatgaactcattgaaagttcaggatttgtgcagtagtggccttggaaaatcaatttaaaaatgtcggaattagggatatggctcacaagtctagtgtgaatttcatgctgggaactaatttaattgacacatgaatgatactttttttttttttttttggtcttttaaatcacgtctgtgtcttctgccaaagacaacaagaaggtattccaagctgcacaatgaggcccaggtaggtaaagccatatactgcattgtgagcacattgaatctaatgtataattctgtgtatttgtgaatccagccttataggtagaggcatttaatatcatctgcctttttttcttttttctttttcttttcttgtaacctactatgagtcaacatgctgtctttatatggctggccataagatgtctaagttcattctctcgacttagtaagtgtgtaagttttttaaaaaggtaggagttaggcaattgatagagatgtaaactgtaaatttccaacagatacatatgagtttatgtttatttttatttattttagagacagggtttcacagggttttgctctgtcacccagggtagacgacagtggtgcagtcatagctcactgcaacctccaactcctgggctcaagagatcctccagcctcagcctccagagtagctgggacctcaggtgcttatcgccacgcccagctaattttttatttttattttttgtagagacaggttctcattttgttgcccaggttggtcttgaactcctgggctcaaggaatccccccgcctcagcctctcaaagtgctgggattacaggtgtgagccaccattgtgcccagccgtatacatgattttaaagtgttgtaaaaacaggaggtgaaaaaattcaactaactttgcatagatgaaaagcatttctataacttcggggatttggcccacagtcctgagcatgtagcttttgcctgcaagacattctcaatcttcaaggagatgtttgcatacagcaaaaaaattgtactcttctgtggctgtcattgtttcagagtatttacaaaggactctgagagccaatagggatgaactcctgtttgtattttttctctcagaggagatatttgaagtgggttttgaaacatgtatagacatgagataggaattgaatcaataatccacatgtccaatattcattacctgataactgagtagggatatgctgagaagagcgtcatgtgtttccttaagaaaatatgacctcagctgggactgagcaaaactatgaagtggactcaggtggtcctcagagtccacgtttctttcttttcctcaattcagttctttccccaacttccacttttcctttacttggtaattccttattttattttatttatttatttttttgcttgtttttcttttctccagccaaagctgctattctcacactttttcttcttttgagggtctcgtcctgtagcccaggctagagtgcagtggcgcaatctcagctcactgcaggcttgaactcctgagctcaagcgatcctcccacctcagcctccagagtagctgggactacaggcatgcaccaccacacccagttcatttttacatttttttgtagggatggggtctcactatgttacccaggctggtgacgaactgattctcctgcctcagccccccaaagagctgggattacaggtgtgagccactgcaacctgactttttaaaaatttggagtaatgataaattgcatgtatttattctttttatattatgaatattttatttttatttattttttctttctttttaaattcatttttctttttatttttttcctttttaaatttctttttctttttttattgtcccttgagtcaaaaaagctgacatataaacattgcatagatttatggtgtacaacttgatgttttgaaatacgcctgcattttggaatagctcaattatgctaatgcatgttacctcatccacttacctatttgtgatgagaacactttgagtagattttatcagtaattttcaactctaaaatacattcttattaactacagtcagcacaagtacaatagattctttgaacttatttctcctgtcaaattgaaattttgtatccttcgaccaacatctccccaacccctccactggccccccagctcccagcaggcatcattctaccctttccttctatgagatcaactttttgagatttcacatagaagtgagatcatgtggtattggtgtttctgtgccaggcttattttccttagcataatgacctccaggttcatccacgttgttgtaaatgacagaatttcattcttttttaacgctgaataatattccacggtgtatatgtaccgcattttctttatccattcatgcaatgatggacactgaggttgatttcacagtttggccattgtgaatagtactgtaaggatcacacacacccacatgcccttaaattagaataaaaattctaattttagaatgaagttaaggttaaatcccttacctgtagagactcatttaagtcccttaaatgaggttaagtccctggaagagggagttaacctcaggagtcttatcgtctccgtcctctgcaatgatttgcccctgagtacgtgttttcagacttccctcctggaagggcatctactttagccttttaaaaaaaattcaatagtttttggggagcaggtgatgtttgattacatggataagttctttagtggtgatttgtgagattttgatgcacccatcccctgagcagtgtacactgcacacaatgtgcggtctttgatccctcactcccctcccaccctttccctgagtccccaaagtccattgcgtcattcttatgcctttgcagcctcatagcttagctcccacttatgagtgagaacatacaatgtttggttttccattcctgagttacttcacttagaataattgtctccaactccatccaggttgctgcaaatgacattattttgttcctttttatggctgagtagtattccatggtgtgtgtgtgtgtgtgtgtgtgtgtgtgtgtgtatgaatatgaaaatttgatatggatagatagatacctgcagatctatacagataaagaagatgtgttatatataggtatctacagatctatagatatcaagagtgtctcgctccaagcaccaagcactgctgctgaatggcagcagaagtgcccaaagaaatgcgctcttggcttctcactttgtatacaatctatagctatctatctctatatatcacattttctttatccactcattgattgatgggtatttgggctggttccacatttttgcaactgcaaattgtgctgctgtaaacatgcgtgtgcaagtgtcttttgttgttgttgttgttgttgttgttgtttttgatggaacctcggtccgtcacccaggctggagtgcagtggcacaatcttggctcactgcaacctccgcctcccgggttcaagtgattctcctgcctcagcccccctagcagctgggattacaggagtgtgccactacactcggctaatttttgtacttttagtagacacagagtttcaccatgttggccaggctggtctcgagctcctgacctcaggtgatccacctgcctcggcctcccaaagtgctgagattacaggtgtgagccaccacacccggccgcaagtgtcttttatatataatgccttcttttcctctgggtagatacccaggagtgggattgctggatcaaatagtagatctacttttagttctttaaggaatctccatactgttttccacagcgcttgtacattcccactaacagtataaaaggattcccttttcactgcatccatgttaacatctgttgttttagcctttattttatgcaaagtgagaagccaataacgcattacgttgggcacttccgctaccattcagcagcagtgctcggtgcttggagagagacactcttgagcttcaggagatgcctgggagatccacgtgatctccaaagacccctgttgtgttgtgttgggaggtggatcctgaatccacccagagaagcctgataccaataaaatccctgcttgctttccaggagacccttggtcttcatgtctttggtgtgtgcactcttgaacacatgccaggcacacagggtgcatgacgacaagcctaatattgtcctaatcatggttgatgacctgggtattggagatctgggctgctacggcaatgacaccatgaggtaaggcggtttcatggccagtcatacgttcgtcagtcgttcaggttcagcaggctggctgtacggctgcatctatgtgcaaaaccaaatgtatttgttgggacttttttttaagttactttaaactttttgatagttttaaattatttagattatgtaatagttttacaattacatttttaataattttaatttgaatctctttcagtttttaaacttaagaaataataattgtccatcttcacagggtacacagtgaggtttggatacatacaaagtatagtgatcagatcagggtaatcagcacatccagtgcctctagcattaaccaggatggtcatagtaaaagcatggctatctggacccgagtcctggctctgcatttactagctctgaagtcttagagaagtcgctgaacctctctgtgcctgttttcttatttgtcgaatgcagagaaggctttatatccctgagtttatgtgtgtaaagaacttagaatagtacctaacacacaactaccctctatcatacagcctattatgaagcatgatgattgtatgtacatgtacatatacagatatgaacatataaatgtcattatataaatatatgtgatatattcatatatgaatatattctataatatataaagtatatatcatacatttattatattacatatccatatattatgaatatatgaacatacattcaatgtataaacatatatgaatatatttataatatatgaatatataatattactaatatatatgaatatgttattcatatatacatgaacatatacatatttctatgtctatgaatatatattcacttttatataaatgtatttttaaaaattaaatataaatatatttaaataaatatataaacatatatttatatattttataaaagtacatttaaataaatatatgtaaatatatattcattttatataaataaatatttatataaaatgaatatatcttcatacatattgataatatataaaagtatatattatcaatatatattgataatatataaatatatatttatatatataatatataatattcataataggctgtatgatagagggtagttgtgtgttaggtactattctaagttctttacacacataaactcagggatataaaggcttctctgcatttgacaaataagaaaacaggcacagagaggttcagcgacttctccaagacttcagagctagtaaatgcagagccaggactcgggtccagatagccatgcttttactatgaccatcctggttaatgctagaggcactggatgtgctgattaccctgatctgatcactatactatatattaataaataaatatatattatttattaatatatatttaattatacatatataaatattttaatataaataaatataatataaatatttataaatatatttataaataaaattatatataattataaatatataattaaatatataattaataaatatatattataaatatagatttataatatataaatatatattaataaatatgtatgaatttatgaatatatattcaattatatatattcataaatatataaatgtgaatatgtatattcagcagaattcattctgtttcctaatttggtgagccaatagattctttaagatggtgagcttgtatttttaacaatgggcattctgaaagaagaaaaacagatatgaaacaaactcagtgctttgtggtggataatagaagctatctgtattagccattcttatactgagcttaggagtacatcgttatcagacgtacatcatacacttttaagatcattgcgttgtatgactaatagatgctgaaggtagtcatcacagttttcgacaacggagctaggagtcatgaaaaagtagtcgccaaaaattaaccattgcttatgagaaaagaagagaggactcaccgaaaagcgcagaaacatggtgtccataaatggcagatatttacagagagtatgttagcgtggggtatcggtgttttgctgaaaatactagcaatttgagaagtgagattataatgtgaaatctaaaaccaggcacatgtgccccaggaatgcagtttacaatttttttctttgcaaaataaataatgttttaaaagttggtaggtgacttccatatctgaaaaaaaaatcagatgcacaccttggtaaagctggaacttctccttgcaccagttacctgtcataatttctctcatgaataaatgtagaactcattatattttattttcatccaagaggagactgattctttttccagaagtctctccagcctccagaaatctcttgttaaattattttttaattgacgaattatagttctgtgtatttctggtgtacatcatgatgttttgattcatggatccattgtggaatagctaaatcaagctaattaacatgcacaaccacacatacttattatttatatgtggtgaaaatggtgaaaattatagcaatttcaagaatagaatacattgttattaactatagtcaccacaatctgcaacagatctcttaaatttattcctctatgtgaggaataaatcaaatagaggatttattcacgtttggctccgtgaaatgttgtatcctttaacctacctgttctcgaccctcaccccagcgcctgatacccaccattctactgtctacttctgagtttgctattttagattccacacataagtgagatcatgcggtatttgtctctctgtgcttggcttatttcatttaatctaatacccttccagttcatctgtgttgtcgaaaatggtgggatttccttcttttgaatatttaatcatatgacagttttgcaacctatgcagactgcagggaaatgtatctatcaaaccagtgagtgggtgggtctgtgagtagttaggcataagtaaggtctgtaagcaattagcctcgatgaatcagaccccaatcccttaagcattttattttgtaaggctgaagtacagtgaatggacaccatatagtggcacccaggtatatgaaccctgcagaacaacagctgcctggaatctcagtcatacttcaccttgacacgggcaaaaaagaaaaatgaactccgtgtgcagttacctgctctgggtacctggaaatcataataaacagagatgttgtttatcttcagatctctctgtctctctctctgtctctctctctcctctttctgtctctacatctctttctatgcctatgcgtgtctctgtcacccctctctgtctgcttgtctctttctatctctctctctgtctctctctgtctccctctctttgtctgcctgtctctctatctctctctctgattgtctctctctgtctccctctctttgtctatctcattctatccatttctttctatctctttctgtctctctctctccctctctctgtccttctgtttccatctgtctctccatctctttctatgtctgtctctgtcttccccctttctctgtctgcttgtctctctatgtctctctgattgtctgtctctgtctctgtctctctctttgtctatctcactctatccatttctttctgtgtctttctctctttccttctctctccctctgtctgtatctttccatctctctctgtctctctcttcctctcttcttctctctctccatctctctctctgtatctctctctgtgtctctttctctcttttcatctctccctgtttgtctctctctgtttttctttctgtctccctccatctgtctctttttccacctctctttctgtttctctctgtctccctccctctgtttatctctctttccatttctttctgtctctctcttaatctctgcatgtctctttccatctctctctttctgtttctctctctctgtctttctctctctctcttgtcttctctctgtccctctctgtctttctctgtctccctctttctgtctttctctctccttttttctgtttgtctctctctttccatctctctctgtttctctctgtgtgtcttaccctttgtctctttctctgtctcttttcatctctctctttctgtttttctctttctatccttttctgttgctctctttctcgtttgtctctctctctctttcatcctttctttctgtctgtctctctctctgcctcgctttctgggtctctccctctctccctgtctgtctctcctctctctttccacctgtgcctttctgtttgtccttctctgtcttcctctcgctcttcctctctgcttcccccgccccccaccttttccttctctccaatacaccttccctctcccccttcaggacgcctcacatcgaccgccttgccagggaaggcgtgcgactgactcagcacatctctgccgcctccctctgcagcccaagccggtccgcgttcttgacgggaagataccccatccgatcaggtgcgcaaactggcgggctctgctgggctctgccctcatgttaggatgtgaggaaacaaaaatgtggcttgaccacgttaacaagtaaaaaagggctgggcacgatggctcacgcctgtaatcccagaacttcgggaggccaaggtgggaggattgcttgagcccaggagtttcaaaccagcctgggcaacagagcaagaccccatctccacaaaatttttttaaaataagttgagcatggtggcatgtgtctgtggtcccagctacttgggaggctgaagtgggaggatcgcctgagcccgggagtttgaggctgcagtgagtgtgatcacagcattgcactctagcctcgttgatagagcatgtgttagaaagaaaaaaaaagatacaaaggaaagaaaagaaaaagcacacatgtgcataggtgcactggcacacacagctagcactggtcacatcaaaatggctgcgcttctcagagatgcaagatcaccctgtgtgcttcagttgtcttttgatgcaatgagagttttttatctgaattccaagtcacaaggtgtacatttgagtttcccaggtcaacaaagataagctgtcttggaatgaagtaattaatacaacatgtgtttacacattcagtctgtcaccaaaaaatatctttttttttctttcaaaccacaaagtcatggccgggcatggtggctcatgcctgtaatcccagcactttgggaggccaaggcaggtggatcacttgaggtcaggagttcgagcccagcctggccaacacggtgaaagctcatctctactaaaaatacaaaaattagccggacatgggggcatgcacctgtagtcccagctactcaggaggctgaggcaggagaatcgcttgaacccgggaggcagaggttgcagtgagccaagattgtgccactgcattccagcctgggtgacagagcgagactctgtctcaaaacaaacaaacagcaacaacaaccaaaaacccacaaagtcataaaccaagaaatagctatcagatttttggacaactttcatcacagcattttacccatggagacagtagtattatccccttgctcaatttatatcaattttattttatttattattattattattattattattatttttgaaatggagtctcgctctgttacccaggctggagttcagtggtgcaatctcggctcattgcaacctctgcctcctgggttcaagtgattctactgcctcagcctcctgggtaactgggattacaggcacgtgccaccaggcctgtctaatttttgtatttttagtagagatggagtttcgccatgttggccaggctggtcttgaactcctgaccttaggtgatccacccacctcagcctcccagagtgcggggattataggtgtgagccaccgcacccggccatatatcaattttagataaaacaaaaatgaaatgagaagaacgaaattatcgtaagctctagttgtcatgttctcattactttttaatttattactattattttgagacaaggtcttgctctgttgaccgggatggagtgcagtggtatgatcacagctcactgcaacctcaaccttccaggctcaggtgatcctcccacctcagcttcctaagtaactggaaccacaagtgtgcaccactatgcctggctaattttttaactacttagggtattgctgtgttccccaggctggtctcgagctcctgaactcaagccatcttccctctttggcctccaaaagttctgggattacaggcatgagcaactgcacccaacctggtgactttttttgtttgtttggttttttgcttttgagatagggtctccctttgttgcccaggctgaagtgcagtgtcacaatctcagctcatcacagcctcaaactccagggctcaagcgattctccctcctcagcctcctgagtagctgagattacaggtacccgccaccatgcccagctaatttttgtatttttggtagagatggggtctcaccatgttaaccaggctggtcttgaattcctgagctcaagtgatcggcccacctcggcctcccaaagtgctgggattttaggcatgagccaccgtgcctggccaaaagtagctatttttaaatgtgctattcagtagcatgtagctctttcccaatattgtacaaccatcacctctatcgaattctagaacatttccatcacccacaaaggagatcttgtccccatgaagcaatcactccccattcccccttctcgcagcccccggtcaccaagaatccactttccgtctctacaaacatgtctgtcctggacatttcacataaaaggaatcatacagtatgtgacagtctgtgactggcgtctgtcaccaagcataatgttttatggtagcctgggtcagagtttcatttatttttatgttgaatactattccctcgcatggattcactacagtttctccatccattcatcaattgatgggcagtcaagatgtttctattgtttagtgattgtgaggaatacaactatgaacatacatgtacaagtttttctttgaataccagttttcaatccttttgggttcctcaggaacctcaattcttttgacattccccaggagtgaaattgttgggttgcatggttctattttttttttttttttttttcagatggagtttcactcttgttgcccaggctggagtgcaatggcgcaatctcggctcactgcaacctctgcccctgggttcaagcgattctcctgcctcagcctcctgagtagctgggattacaggcatgtaccaccacgcccagctgattttgtatttttagtagagacggggtttccccatattggtcaggctggtctcgaactcctgacttcaggtaatccccctgccttgtcctcccaaagtgctgggattacaggtgcgagtcaccacatccagtcatatagttctatttttaaaggtgagggaagtgggcttggggcatggtggctcacacctgtaatcccagcactttgggaagctgaggagggcagatcagttgaggccaggaattcaagaacagcctggccaacatggtgaaaccccatctctactaaaaatacaaaattagctgggcatggtggtacatacctgtaatcccagctactcgggaggctgagacaggagaattgcttgaactcaggaggcagaggttgcagtgagctgagatcatgccactgcactctagcctgggcagcagagtgagatttcatgtcaacaacaacaacaaaaaaaaaaaaaaaaaaaaaagagagagagagaaaaaaaaaaaagaaaaaaaaatggtgagggaagtagtcttcgcttgtgggtacagatgccgcagtttaatgccaaattatgtggattccagatagcggttcttggaggcagaataaaatcgcacgtatcaaccctactgccagtctgctgacactgactttggacgagaagaaagaaaaggtcttttttggctgagtgcagtggctcatgcctgtaatcccagcactttgggaggccaaggcgggcagatcatgaggtccggagatgcagaccatcctggccaacatgatgaaactccgtctgtactaaaaatacaaaaattagctgggtgtggtggcgtgcacccatagttccagctacttgggaggctgaggcaggagaatcacttgaacctgggaggtggaggttgcagtgagctgagatggcactgctgcactccagcctggtgacaaagcgagacttcatctcaaaaaaaaaaaaagatcttttcttagtctgtttgggctgctataacaaaaataccatagactgggaggcttatctacaacagacatttactgctcacagttctggaggctggaagtccaagatcaaggcatgccagattcagtgtctgctggggacctgcttcctggttcatacacggcgccctcttgctgtgtcctcacatggtggaaggggtgagggagctctctggggtcccttttgtaagggcactgattccattcttgaggctccaccctcctgacctcatcccctcctaaaagccctacctcctaaccattaccttgcagatgaggatttcaatgtgcaaattttgtagtgacaaaaatattccctctgtagcaacacctactcattgtacttttttccacactacatctaggtatggtttctagtggtaatagacgtgtcatccaaaatcttgcagtccccgcaggcctccctcttaatgagacaacacttgcagccttgctaaagaagcaaggatacagcacggggcttataggtaagacacaagaattggtgttagtcattgatcataaggtaatcatgtcctttgttctacccttgatttatgactttcttggaaacgctgtattttacaatgtcttatgtaaaggcgcagtggcccatgcctacaatcccagtactttgggaggccaaggtgggaggatcgctggaaaccaggagtttcagaccagcctgggcaacatagaaagaccccgtctctaaaaatataaaattagctaggcattgtggcatgtgcctatggtcccagctactccagaggctgaggtgggaggattacttgtggcaggacttcttttctttattattatttttaaaacagaggagtctcactgtgtcacccaggctggagcacagtggcacaatctcggctcactgcaacctccatctcctgggttcaagggattcttgtgcctcagcctctcaagtagctgggactacaggcgcgtgccaccacgactggctaatttttgtatttttagtagagatggggtttcatcatgttggccaggctggtcttgaactcctggcctccagtggtctgcctgccttggcctcccaaagtgctgggattatggatgtgagccaccacacctagtctgattcttcacacagctcagtgataggagatgttttaaaatgaatatattacaagaacataaaatttttctggctctgcctgcccgcatagtctctcaccgtgtatcctgtcatctgcctctttatttcactaaaaatggaccacacagattttcttctcactgccaaggatgatagaagtcctcagccacccagtagttggaactccaactactattcctgtttgggaagcctgggtttcagctggtgtgagaataacatgctgttttaaatcccttcaatttttgtaatacatctgctgttgataagagaaggcaatctccgtggggttgcaggacaggaagcctaagccagtagcactgcctctcctctacctatccccacaggcactcagaggttgatggaagcacaggcattcttgatggggccctcaccacatacaggaagctgttaatattcctagtagatacacattatcgcagcctctgagggtttgctgatcatccacatgctagcaggactcacaggcaccctttggtgatcattcaaggtgtggtacgttttactgaataagtcccttacttcgatcagttttaatgagagcccctaggatttgcagtcagccagctattcatccatccatgctggtccatcctccatgatttatctatagctatcatcggtcatctctctctctttctccatccatccatcaacccatatatctctatgcatctatccatccatctacctgtctatctatctacctgtttgtctattgatcaatccatcatctatcatttatctatcatctatgaatctatctacccatcatctatctatcatctataatctattcatccactcattcatctatcatgtatctatctatccatcatctatatctgtctatttatctagccattcattcatctatttagacatctctctatccattcacccatccacccatatatctctatccctgtctatttatctatctgtctactcacccatctatcctttcatccacctacatatacaaatatgctccatctgtcctccatcatttatttgtacgtgtcatatttattacatctatgtctctattgatatatacatacacatatgtatacatagatgcatactccataatttatttttatccatatcttacctgtctattcatccacccacaacacagatctattcatgcatctctctatctaatcacccactcatccaggtatccatctgtccacctacacacacatatatacatgctccatctatcctccatcatttatttgaatctgtcctatcctatcttatctatttatctatctatccatctatccaactactcactctatctctatcatctatttatctatctatccattcatctatcaatccatctatccatcatatctatctatctatctattcatctatcctatctatctatccacccatagatctccatccacctatctactcacctactcagccacccacctatctatccatgcatccacttacacatacatacatgccccatctatccatccatcatttatttgtatctatcatatttatcacatctatctctctattgatatatacatacacatatgtatacatagatgtatacaccataatttatttttatctatcatatcccatctgtctattcatccacccacaacacagatctatttgtgcatctatctaattagctagtcatctatcgatccatccatccacctacacacacatctatacatgctccatctatcctccgtcatttatttgaatctgtcctatcctctcctctcctctatcctatctatctatctatctatctatctatctatctatctatctatctatccatccatccatccatccaaccactcactctatctctatcatctatctgcctatctttctgtctacatattatctatcatctatctttctttctatcatctctatttatctagctagctatatctacatatgcatctgttcatctgtctatctacctatctttctgtctacatattatctatctatatatctacctacctatcatctctagctagctagctagctctatctatgtatacatctattcttccatcaactataacctgccttgtctctgtgatgtatctattcttccatcatctgtaacctgccttgtctctgcggtgtatctattcttccatcatctgtaacctgccttgcctctgtgatgtctctatctttgtggctatgactttgtcttctcagtgaatgagaaaatttctagttcacgtcattgacagaaactcacaattctatttttctcccttattgtttatcctatcctgttgctcacaaccggatctgaatacaaacttcctctgtaaactaaagaagaacaaaaaaaatgtggctaagtggcactcggattttttagaggaaggagaatatctctgctactttatttttgtgtattagctgattgtttcacgtgaagaatgctcacatggtttttgcaatgtgctggcatatgttgacatattgatgcgtagatgtgtttgtgtgtttggttttaggcaaatggcaccaaggcttgaactgcgactcccgaagtgaccagtgccaccatccatataattatgggtttgactactactatggcatgccgttcactctcgttgacagctgctggccggacccctctcgtaacacggaattagcctttgagagtcagctctggctctgtgtgcagctagttgccattgccatcctcaccctaacctttgggaagctgagcggctgggtctctgttccctggctcctgatcttctccatgattctgtttattttcctcttgggctatgcttggttctccagccacacgtcccctttatactgggactgcctcctcatgcgggggcacgagatcacggagcagcccatgaaggctgaacgagctggatccattatggtgaaggaagcgatttcctttttagaaaggtaagcggaataattacaaattcatgtaataatgataatgatctcttttttaaaaggacctagatagatctgtagggtgattgtagtttataataatctattgtacacttctaaatagctaaaagagaataagtcaaatggctctagaataaagaaaagacaaatatttaaggtgatggacaccccaattacactgatttgaaaaaataaatcatttgtaataattctttacaaattatatgaatgtattaaattgtaacgtgtactcttaaactatgcacatctataatgcattaataaaaataataggggatgatggtattaaaaatattgagttaggaaatggaatattgctaaatggtgtaatagggttagataaaaatatgaagtgtattgaagaccagttggactcttcagttggtacctaaagcggtggtaccttgtttgggctcctgttattaaaatcatggcctctctattggctctgaaatttatatgttgtcagaccatggacgcagaccctagtaacttaaactcacaaattgtttacgttaatttacaatgcatcttgtcatcatgttaacttacaacagggaatatgtacatatacaatatgtatatactatactatatatgtatatatataatatattttataatattttttgtctggttccctgatacatatagataaatatatatatatatctggaaatcagatgaaaaaagtaagttttccattgcattatgttcctgttgttaaaaaacaaaaaaaaagctacttggggaaattaaaatcagaaggcttctctttgagcatgtgatacgtaagggctatttcatgaattggatgaggtaaatggtcaaaggtgattgttataaaaactttatgcatccagaacacaatgactggaaattttcaagggtatctatcctcttgttgttggaccttctttctttaaaaaaagcctgtaaacacattttttcatttgctttttccatattgattgaggcttaatctttaccaatagccattctaggatctggattttcaggatgtaaggtgtcttgtgtactctggtacatagctttgtcctcactctgtagcccaagtgaaggtgataaatatgtagtttggggctggcagcggtggctcagcactctgggaggccgaggagggtggatcatctgagaccagcctgaccaacatagtgaaacgccatctctactaaaaatacatattagctgggaggctgaggcaggagaatcgcttgaatccgggtggcggaggttgcagtgagctgagatcacgccattgcactccagcctgagcaacagagggagactctgtcttaaaaaaaaaaatgttgtctgggagtaataaagccatacttgctctgtagatgcaactgaatgcttggtgtcacttagagcaaatctttctgttccctggtacctttccaaatgtgcagagttctatgaatttttacagacagagcatcaatatgtgcaaattagcaccaaccactctgaaagtatatgataagcaatcctattctcttctgtctgccagttcgtcttcaaacattcccacacagttctccttaggaatttacatgagtacttgaagaacagatcctatggttgagatgtacattgttcaccaaaacctctgtcgagtttcaaaagttccatatgatccacaataacacaatattgaatggaaaaaacaatggtgaagaggaaatataaagacttggacgttgtgacaataagctcatggcttaggttcatgaatgctcaaaactatttttatctggattctcagtgtatgactctcctacagttgctataacaaatcactatagggctgagtccaatggctcatgcctgtaattccagcactttgggaggctgaggtaagcgatcacttaagttctggagattgagaccagccaaagcaacatatgggagccatatttctacaaaaaatacaaaaaaattagttggatatgatggcatgcatcagtagtcacagctactcaggaggctgaggtgggaggattagttgagcctgggaggttgaggctgcagtgagccgtgattgcaccactgcactccagtctgggcaacagagtgaggccctgtcttaaaaaataaaaaaaattaccacaaatgtagtggcctaatgcaacacaaagttattattctgctgttcttgaggtaagaaatccaaaattaaacttgtgggctaaaatcaagatgttggtggggctagttacttctaggggttctaggggagaatctgttttctctttcttctagtttcttgaagctgcctgcattctttagcttgtagggttttgttttctgactcagacccttctgcatctctcttataaaaggacatttctgattccactggacctacccagataacccaggataatcactttgtctcatgatccttaattcattcccatctgcaaaaaccttttaccatgtaatatcacatgttcacaggttttgagaatgaggatgtggatatctttggaatggggcattattcagctgatcactttgaccacgactctttattttggcagcttagtttgggatgcaaactatttaattttaaatatttaatgttcagagctgtgcttcctctgtaggctctaggggaggattcttcctgcccttccccactcctggtggcttcaggcatccctgggcttgtagccgcatcactccagtctctgcttcatctgcatatggccttcccctctgtgtttgtgtctcatcttctgtctcttataacgacaatagtcattggatttagtgcccatcctaattccaggatgagctcatcttcagatccttaattaattacctctgcaaaggtcttgatatccaaataaggtctcattccaggttctgggctttaaaatatatggacttatatttctgggggctactattcaaactactacaattgtatccagtttcttctggaggctctaggggaggatctcttctgcctcctctagctcctggtggctccagatgccccttggctggtggttgcattactccatttccacatggcctcttcttctgtgcttgtgtctcctcttctcctatagggacaacattattggattggggactcatcctaatccagaatgatcacatcttaagtaattaaatctccagaggccccatttccaaataaggtcccattctgaggtttcaagtgaacgtgaattttgaggggtcactgttcaagacaccatgacataagtcttgtttttaaaattcattttttttatttctttatattttgatatctcaccagagcagaaatttcccaacgaatggcatttgtgctgtgtgttttcctgggtagctgaggacttatcattcatgcagatggattatcaaaattaacagcgggtcagcctagttccctgtatcctcatgtgagaacctacagggtgcaaatggcttgccaaggcattcctgtttgtactggcttatggctcgtgaaactcttgatctggctaagaaatgacttccataccactgtctcttgatgtatctcagggtgtgaccctagtttgaggcttcacgagcagtgagaacatccaccaaacagagctggatttgacttttcgcactcgcatgatatgggaggtccgtgttggcttgcagtatattctacagctgtcctggcatctgagaatcaaaggaactgtgatggtgtcacaggactaccaggttcatatgcctgctgcacagtaacataccaatacactgaggcagcagggtttatggcagagaaaggtttaataattgcagggcaattagtgcgaacatgagaggagacctcaaatccatctttttttttttttttgagactgagtatcactctgttgcccaggctggagcgcagtggtgcaatctcagctcactgcaacttctgcctcctgggttcagcgattctcccacctcagcttccccagtagctgggattacaggagcccatcatcatatctggctaatttttgtatttttagtagagataagatttcaccctgttggccaggctggtctcaaactcctaacctcaggtgatccgccatcttcagcctcccaaagtggtgtgattataggcgtgagccactgtgcctgtcctcaaacccatccttccaaggagttctgggctggattttttaggggaatcatggagggtcttggggtcactgatgggttggggtaagagggaatggaatcatcagaatatggaaatggtatgctttggtaagtcagcttctcatagggtccttcagagaagcagacatcagcagtttccctggtatgcacaacctgaaagattattgcaaatggaaaacttaacatttcatgatgttatgttatcatcctgtaacaggatctgtgcgattctagaacaaataggtaccaaacaagtaggaatacatagatgagagggcaagctgacctcaggatcaaagctgagtatgctgcaagcttagttcattttgtttctcccgctcccttcctctctgattgattttatgaagtttatagagatggtttcagtagcattaccaaaggggttagggagcagttgaggtgctgcaggatcatggagtccattctatgcaggatggggcccttgggtggacccactctatcttctgcagcttggagaagaaggaagcaggtcatgtctatgagaagccaaaacaatagttttcacattcatagatattgaaaactcacaagtagtttcattgatgtcttctcaggcacagtaaggaaactttccttctctttttctcctttcttcacgtgcacacacctctccccaccacggacgatttcactggcaccagcaagcatggcttgtatggggataatgtggaagagatggactccatggtgggtaagtcacaggacttaagtggacagaaactaacgtgttctgataggacaggacacctgaaaactgctcttggtcaacctgtagagtgaagagaattatgcctatgggacagagtggtctgagacattaatgaggtaatagttgctagcaattgagaaagtcagcaaaaaaactatatgcatttcctctcctttctttgcatgctgtccacttatcaacttgggtctttgtctacttgactgcgtctccagtgctggccagataacaaatcaaatcttcttttcaaaaatttcaactcttgttttagattcagggagtacatgtgcaggttttttacctgggtgtattacgtgatgctgaggtttaggatatgatcaaacccttcacccggacactaagcatagcacgcaatagttagttttcaacccttcccccactccttccttcacccctctagtagtccccagtatctattgtactgatctgtgtgtccacatatacttgatgttatgctcccacttattttgtttcatttttaaaaataaattttattgtgtattttaagattcacaacgtgacgttaaaagatacgtatagatagtaaaatgattactatagtgaagcaaatagtaatcattaagtaacataatatagtaatattaagtaatagtaatatagtaagcaaatgtatctatcatctcacactgttacttttttgtgacaagatcagctaaaatctatttaacaaaagtccagctgagcacagtggcttccatctgtaatcctggcactttgggaggctgaggcaggaggatcacttgagcctaggagtttgagaccagcctggacaacatagtgagaccctgtctctacaaaaatacaaaaattagctgagtgtggtggcatgtgcctgtagtcccagctacttaggagactgaagcgggaggattgcttgagcccataaattgaggctgtagtgagccatgattgcaccactgcactccatgcactccagtctgggtgacagtagctcccacttataagtgagaacatgcagtatttggttttctatgtctgcattaatttgcataggataatgtccaccaccggcatctatgttgctgcaaaggacatgatcttgttcttttttatggctgtgtaatattccatggtgtatacgtaccacattttctttatccaatccaccattgatgggtgcctaggttgatttatgtctttgctcttgtgaatagtgctgtgatgaacatatgagtgcacatgtctttttttttttttgagacaagatctcactctgtcactcaggcagaagtgcaatgacatgatctcagctcactgaaatctctgcctcctgagctaatgcgattctcctgcctcagcctcctgagtagctggggctatctataggcacatgctactgcgcccggctaatttttgtattttttgtagaggcaaggtttttccatgttacccaggctgctcttgaactcccaagctcaggtaatatgcctgcctcagcctctcaaagtgctgggatgacaggcatgagtcactgcacccagcccacatatctttttgatagaaagagaaatcatattttcagactctttagtgacatagccaaactttatttcaggtctgttgagcaccaatatcttagttggggattgggaattaactggtaagtcagaatccagtaccctcatgaactcatcctgtagagagaacaatgtaaatgggacgtcctaggacttacatggtaaatgtattgattagcaaaatggctttaattttccaacattaatgaaagaaaaccatgagtgaaactcacatatatgcaggacacaaatttaaagtataatattttccagacacagatattgtgaaatatatgtcactaaatagaaagacgctttggaaaattaagcctggaaaaagcaaagccaatttgcatagtcttaaacacataaaaaatatgaagtatttaaaaatataaataatattcaaaccaaatacatgaacatgaatagatgtttatgtaggtataagtgtgtgtgtctgtgtctgtagtgtttgtgtacatatgtatagaaacagatgattgacagagatagatgatggatagatagatgataggtaaatagatgatagatggatagatagatgatggactgatagttgatagatgataggtagatagatagatgatggatgatagatagatgataaatagacgatagatgatcgatagaaagatagatgattgagagatagatacatagataaacagatgatagatgacagagagacagatgatagattgatagattatagatggatacatgaatagaaagatgaataaacagatatatagatgatagatggatagatatatagataagtacatgatacatatgacagatgatagatgacagataagataggtgattgatagataagatagatagatgataggatagattgacagatacgtagatgataggtaggtagatagatgatagatagatacatacatacatacatacatacatacatacatagatacatagatagatagatagctatgcatacccctcttactttctgcctccaccagcactagtccttaaagtttagattcttaatattgcactcaatctcaaaaatcgtggcgatcctatttttgatttgatctttgaaaatcaatgaaataggtcattcaaactcaggctgtgataagtaaaagacattactatttgctttaaaaatttaaattaacaaagctcccaaagtatctaatttaataaacctgatgatgtgtcatagtgttcaaacaaggcactttgggtatgactttaatttcgatgggatttttctggtgacattcagataatattacgcaaacggatgggtgtgttgaatctggttggacaagctgtgatatctgaaaattatattttgaaaaagcgcaactgagatgtacatgatactggtgcccagaggttttgaatgttttgtccacacagccagaatcaagcctttaggaagaataaacatctgctttaatatataattttagcaattctcaagcaaacatatatttaccctgaaattatttatcccagaagctgtaacaataccccaagtcctaagaattgttgcttttcttattagaaaagttgatttgtggccattcctggtagagatatcaccttcctgccttttataattatcataggtggccgggcgcggtggctcacgcctgtaatcccagcactttgggaggccaaggcgggtggataacgagttcaggcaatcaaaaccatcctggttaacactgtgaaaccccgtctctactaaatatacaaacacatccgtggtggcgggcgtctgtagtcccagctactcgggaggctgaggcaggagaatggcgtgaacctgggaggcagagcttgcagtggccgagatcgcgccactgcactccagcctgggcaacggagcgagactccgtctcaaaagaaaaaaaaattatcatgggtttcccacagcagtgccctgaaataatggagtctactgatagaataaacatttattttcattttttaataatttccaccttttattttagattcagggagtacgcatgcaggtttgttacctgggtatattgcatgatgccaagatttgaagtacaatagctcctgtcacccagggagcgagcatggcaaccaatagatagattttcagcccttgtcccccaccttccttctccccttttggagtccccagtgtctattgttcccatctttatgtccatgagtacccaatgtttaactcccacttatgagaacatgtggtagttggttttctttttctgtgttaatttgcttaggacaatagcctccagctgtatccatgttactgcaaaggatgtgattttgttcttttttatggctgtgtagtattccatggtgcatctgtaccacattttctttatccatgtagattggttctatgtctttgctattgtgaatagtatgataatcatgcaagtgcctgtgtctatttggtagaatgatttatttccctttgggtagacacccagtaatggcattgctgggtcagagggtagttctgttttaagttatctgagaaatctccaaagtgctttccacagtggctgagccaatttatattccaaacaatagtatataagtgttgcatcttctctgcagcctcaccagcatctgttcctcttttatttttttgacttattgggttcgtgcaaaagtaactgaggtctttgtcattgaaagtaatgatagattgatagattatagatggatacattgaaagtaatgacaaagacctcaattacttttgcaccaacctaatagtagcctttccagctggtataataaacacttttaaaagtgatacttcctatgggccatgcactgttaccagtgtattctggatgaatccccacaacatccccggagacgagtatcatcttcatcatcatgtttatctccattcacagagaaggaggcaaaagtatgtggcctttggtggctgctcctggagataagccagggttgggctccaaagctcttactccctagctcagctacctcttatgcagggcaaagaagtcatgttgaatgatgaggaaggagagctacattcttctctgaagtctccagtagccccattagactcctacagaccgtcatttcacaggagtcagaaaaactccaaaaacttcccccaacctggcttcctgcttccttcgagcccagcgagaggctttcattggagataccacccttgccccacccaggggaaaatctctgatgccgaatgagtcatgcatttctgcatgggcaagagtccatcagcttggatctgaagagcaggtttctcaagaatgcagataagaaagtaaaatgtgcaaaaatgagtaggagaaatggccttatcagcaggagatgagacaaggatgagggtcttggctgagcctgttgtacagacagttgtgagtggtggaatcccagggcaggcctgtctgtggacagcaacacagcttgggcagcaaccctggacagggcagaactgcaaaggaggctgtaaacatgtatttctatgtcatatatatatataatttatatgaaatatttgagacacatatataaaatataacttaaccctttataatatatatatttatattatttgttatacatattagtattaataatttgaaagttatcatatatatgaatatatattatgtatttctgtagcatataatttctatatttatttatttatttcagttgatgttagaaaggtacgaatcatttccatggttgtaatccctgctactttggaggctgatgtggcaggatcatttaagcccaggagtttgaggctgcagtgagccacgattgcaccactgcactctagcctgggtgacagagcaaaatcctgtctcagaaataatcatttccatggccactatgtaatctctctaaattttaagatataaatagaataattgaatataattgaataatattaagaatacaaacaactcaaagtaatttaatattatttgtaaagaacagaattgcctatgttaaaaaccctagagtttaataaaacacatatcagcacatagatgacatatgatattataataaaattatattacatataatttatattatagttatattacttatatacatcattatattattatgttcatatataatataaacatatcattaatatacaattattagattttaatatattatatggttctatcttatatatatcacaattatgctatgcatattatatattatgtacatgtatacatcagtaccatagaggttttattaaactttctggggtttccaacataggtatgttcactacatttaatgttaagtttgtattttatgtgttaaagtatgtatttaactttaatgttaattgcattagtcaggttatgtacaaaaataagttacataatgacaaaaatattcttatttttctggtattaatgaaatagtttcaatttttacttttaagcataatgttgactgacgctttgaatattttaattcttaatattttgagagacttataagatgtgcattaattagatagtagccaggaaaattcttgcatgctttctagtattacctaactatatatatgtatatgtagttaactatatacatgttatatatcatgctgttgatattatctatattttatatatatctaacaatataacttataaaacatttttattatatacataaatacatatatactacatgttatgtagtatatgtgttctaaagattgatatataatataataaatacatttgtttttgtatagtatatgttagtatagtattagtccaatagtataattagttacatttatatattagctatacataaatatattagctatatataaaaatatattagttatacatatatatgaagtctacagtgtttctctgttgggtatatgcaccaaaattaagaccttttctttttgttaaaaataatgcatttcaagatacaatggatcaccagctactattcattatagctccaatgtcaataactaaaatatttagaaataatttttcaagcagtaaatgagtatctcgaagctgactcatgaaagaaaacttgaatacatggaaaggaagagtggattgtatacatgtattagttatttcaaagttaatattgaaggctaaggtagctctgattagagcattaattactgttctctggggagtggtcattatagaggtgatgatgaaatacacactgaataaactgataggaaataaactttccagaaacatctgatgagaaagtctttggtagaaaacatcaagaaacacttctgtgatcataagaaatgctatcaaaaagataactacaaaaattaaaacgcagaaatacaagatttgacttttagatcaatgaagcagaaaataatagccttagagcaggtctgggaaagagaaggacattacattcggtacaataaagtttttaaatcaaggtggcaggggtgaaaggtgttggggaaagtttgtgttatgagttgacttacatccccccaaaaaggtatgttcaagtcataatccaaggtatgtgagaatgggatcttatttggaaatagggtcgttgcaggtggaatcaagttaagatgaggtcattgggggtgggtcctaatccgatatggtgaattaggatgaggctgctacatgccaaggaaggctaaggactgatgccaactgtctgaagtgaggaagaggtaaggaaaggtcctcccctagaaacttcagagagagagagtgactctgccaacacattgattttgaacatctggcccccagaactgtgaaagaataaatgtttgttgttttaagccacctcatttgtactaatttgtttcagcagcccaaggaaattcacagagttagtttaggaaaaaccattaccaattcaattagcatgcttttccatacacattaaggacattgagtgaaacaaaacaaaaattggaagaagctatagttaaacagtaaatttacatctggatgaggtatagtgttagtaatagcaaaaggttatctgataagtagcatgactaaaggccctatgcaaactgaggaaatattagcaacaacatgacattgttttaactgcttgacaaataaagagttcttataaatcaataatggaaacacataattccttccaaaaatatcagcaaaattttaaacatcttttacagattaaaagtacaaatattagagtggacacaggaggaaactcatgatcattcataatgtaccataatcacctatcaaacattagatactgatgaggaattgagaaaatgaactattattaatgccaaaagttgttcattatggcattttaaattatggcaaagtatgaaaattaaccagaatagtgaacaacagtaaaatggttaaataatttatactacttaaaaataaagtatcataaattgtttaggccaggtgtggtggctcacgcctgtaatcccagcactttgggatgccgaggcaggcagatcacctgaggtcgggagttcgagaccagcctgaccaacatggagaaatcctgtctctactaaaaatacaaaattagctgggtgtggtggcgcatgcctgcagctgaggcaggagaaatgcttgaacctgcgaagcggaggttgcagtgagctgagatcgtgccattgcactccagcctgggtaacaaatgcaaaactccatctcaaaataaaatatatatatatacacatacacacacaacacacacacacacacacacacacacacacacacacacacaatggacacttttccagccattaaattgtacatataattttttaaatttatttttttaattgagacagggtctcactgtgttgacaagggtggtctcaaatacctgagctcaagggatccgccttccttgccctcccaaattgctgggattacaggtgtgagccatgatgcccagtcttgaataattttttaacacgaagattttccgagaaataatattggatgaagaaagcaagttgaaaaccgttcatacaatatcaacccaaatagagagagagagatgcatctacaagagtatgtgatatggtttggctgtgtccccacccaaatctcatcttgaattgtagctcccataattcccacatgttgtgggggggacctggtgggagataattgaatcatggaggcagtttcccccatagtgttctcatggtagtgaataagtctcatgagatctgatggttttataaggggaaactccttttgcttggctctcattctctcatgtctgccaccgtgtaagatgtgcctttcacctcccatcgtgattgtgtgtcctctccagccacgtagaactgtgattccattaaacctctttttctttataagttaccccgtctcaggtatgtctttattagcatcgtgaaaacagactaatacagtatgtaacaattttttttaaatagtcaaatggcaatggggcaggaaattggtggtctttattttcctccttataattttctttatttttttgtatttcccaagctattttgtatttttataatcagaaaaatattagctttgttgttttttcttgctacttttcactatttactgaaaagtagcaagaagagtaaaaacaactcccgtgtccccttcacccatctttcccaattgttagcaatttatcaaatatatcttctctcgcccctcttcctttctcctgatcatcctctttcttcctctctctctctttctctcttccacctccacatgtttcttatgcttctgaatatttgggaataagatgcagatatgatgttcattaaatttagaaactttagtgtgtattttctaaaacaaagacattctcctacatcatcactgcgaatcatcaaaatcgggaaattaacatgggtggattcttaggatttaattcacaaatcccagccaaacttctccagctgtcctcaaaagaaaatttatacacagcaagcaaaaccaatggacaaacaaaaaccaaccaacaaaacccctacttcctctaccctctttctgttctggtccatggattttcttgttgtatctgtttaaactcctctgatctggacaaagactgagcaatctttattctttcttgaattcaaagaccttgacattttctgagaataaagaccgggtatcatctagaatgtcccttgaattgggttggtttgacatttccttcaatggaagtggaagtgatggtgtgttctcaatccagtagacaagtaagtgaattagccccaacaatggttataaaattcttcatctcttgattaaatggtgtcttccagttttctccactgtaaagttacttattttgtcattacttaataatttgagatttttaactattttatgggagatactttgagatgaagccaatattttggttcttatcaaacatttaatgccaggtttagcatccattgatcattttctcttggatgaattttcagtgcgatttttgctaaaagtattgtggtaaatttttaaaagtattttaaaatataaattctttcttaacttgcccttacttgtgtgccttggctctagaagaaaatttctaaggtatagtactttaggaatgttaatgtaatgttatctgagataaccaacagtagaacacatagaattagacacgtttgagactaataagctttttcataattatgcataatacagactgggtttgggaactctaggaatttagctattttcctataaaaatgattggaaatgtggtttattttgaatacattcttcctcttttaacttgcccattgagtctaattctcccaacctagtcatcctattctctatttaaaatatcaaataagaagggaagggaaaatggttaaagaattacttatctaaatcatctgcaagaatatatcaaataaattatgtgaacccaacagtgggagtgtcttattcttgcctctgtctcctcaaattctgtaacaatgtctgccttctgtgagcagagaggttgcataaaccgtgactgccattctgtgcaacatcagtcagaataccactacagtccttcgtttcatatccagtgggaaaaactgtatttctctgtttaatgttttcattctgcatgaaggaaattatcaaggagaatttgtccttttaaatgataccagtagcaactgatgttcatttgtattgccataatatttttttcttaaagcaggtcatcttttatttcttaaaaattttggactctcagttttttgtttttttgttttttgtttttttgagatgagtctcactctgtcacccaggttggagtgcagtggcacgatctgagctctctgcaacctctgcctcccgggtgtaagcaattctctgcctcagccacctgagtagctgggattacaggcctgtgccaccatgcctggctaatttttgtgtttttagtagagacagggtttcatgatcttggccaggctgatcttgaactcctgaccttgtgatccacccacttcagcctcccaaagtgctgggattacaggcatgagccaccgcgcccggcctgactctcagtttttttctctttcaatggtttgtcaatttaaactgttaatgcacatttcttttcttttgtggcttttgacatagggtcacaccatccttgttttcctttagatagctcatgcccatttgacttaggggtgaaatacctcataatgtcattatttttacttgtctcttgtatattattttaggcaagattcttgatgctatcgatgattttggcctaaggaacaacacccttgtctactttacatcagatcacggagggcatttggaagctaggcgagggcatgcccaacttggtggatggaatggaatatacaaaggtgaggagaggaactcatgcaagtgatctggtggtgaataagcttttttgtggttcttataattaaagcccatgacacaaaggaatgaggcctgaaaaactgaacaagtttgtttaatttgactcttagtaaaatgaagtattggaccaaggtcaagaaaattggtcttacatttgttaacatttctgtggaaggaagccatttatgtagagggagcatctagaaatatgcctttctgacaaccctatcaaattatgaggagttagcacaagcagatgcttttatggggtctttaaagaaatatctactcattcattccatttatgagattattgagagattaaatgagggggagtgtgattcctagagaacagagatcagaaaccagggatccttcatcattaagaagtcttcgacactctcttccaaggatatagtacagcatagaaagtagacaagcctgtcttgggtttcatgattaaattcacatatactgattttatgtcctgctgtaacatttagtccacaaaataggtccataagctactacattggccagtctataatgtgtaacctgatgttagaatattatcttcatttgtgaaatgaggattaaaaaaagaaaaagaaaaaagataattatctggaaaatgtcgagtatattttatcatatgtcttgagagagattttaaagtattttctagaggaaaatacgttgttattcatgcaactacagattccacagtcttggattcggtaggaaattataatttctgtatgaatgaggtaaaggctctgcctccatcttgcagagggtatgaatgtgtactctttagagcgtgtagcactaaagtgtgcacttaggacccaaaacaaatccttagtggaaattgttattatagacattctattttaaaaaaaaaattcagtagttttggggttacaggtggtttttggttacacagataagttctttagtggtgatttctgagattttagtgcaccgtcatctgagcatgtactctgttcccaatatgtagtatttttttcctcagcctactcccaatcattccccaaagtcaccagagcccattatatgattcttatgcctttgcattcttgtagcttaactcccacttataagtgaaaacaggctgtttggttttccattcctgagttacttcacttagaataatggcctccagctccatccaagttactgcaaaagatattatttcacttatttttatggctgagtagaattccatggtgtatgtacaccacgttttctttatccacctgttggttgatgggtacttaggcttgttccatatctttgcaattgagaattgcactgctataagcatgcgtgcgcatgttagacattgtatgtttgcttatgggaactgtttttaaaaatttttggctcatgcctgtaatcccagcactttgggaggctgaggcaggcggatcacaaggtcaagagatcgagaccatctggccaacatggtgaaactccatctctactaaaaatacaaaaattagctgggcatagtggcggacacctgtagtcccagctactcaggaggctgaggcaggagaatggcgtgaacccaggaggcggaggttgcagtgagccgcgatagcaccactgcactccagcctggcaacagagcgagactccatctcaaaaaaaaaaaaattaacttttcagcatgccatgacataatgtagattttactctgattaacttaataaaataagagtcaattaacacaggacagtggccacttctcctaatttccccctggaaatcctggtgtatgcctgtcatcttggtataattaagacaactttctgcttttattctcaataataccttgatgtggacaataagttaccatatgtccatagtattccatttgttttcaaggtgcatgaatcaacagtgagcaaaataggcagaaatcctcgtcttcatggagtttatatcctactggagggaggcacagcagaaaataaaataaaataaataaataatatggcatattagaaggtggctgtaaataagaaaaaacacgagagtaaagaattctggggtgggactgccatttcaaataaaatgttcaggcacgcctcattgaggttactgtgagttccataaaattgggggctggatacaagaaaaatattaattaaaaaaaatataggaagttactttgagcaaaggtatgagggaggttggaaatgaagtaggtgtatatttgagataagaacactttaagtagagaaaatagccatgcaaatagaatgtaaatgtccaatattacatatgcttagttatttaatcaaaaacctaccagcagcacaggaaaatataattctgtagacgtgcactacttaccccactaggactctacatagagtagacactatacaaatgtgatctcttttgatactagcttaccttttaaatacattcaatacagtgactattttaactaggcacaataattgaacttaattgcattgtcttataggtggaaaaggcatggggggctgggaaggtggaatccgcgtcccaggaattgtccgatggcctggaaaggtaccagctggacggttgattaaggaacctacaagtttaatggatattttaccaactgtcgcatcagtgtcaggaggaagtctccctcaggacaggtgatgtcatataaactgttaacaagagcttattttcacccttcttccttctcagaagattcagaacaaggagactgactctatcctggcagacccactttttccctagtatctacacagttttaccttcctatatgactgtgtctattcagcatttttcagaagagaccagtcttttctttttttctattgaggtaaaatatacatatataatttaccatctttaccatttttcagtatacagttcagtggtaataaacatacttattttctttttttccccttcattttcctctcatctctcccctctggtcatcactattctactttctatcttcctaagattcactattatttatttttagctcccacactgagtgagaagatgtgatgtttgcctttctctgggcttggcttatttcacttaacataatggccaccagttccattcatgttgctgcaaatgacaggaattccttcttttttagggatgaatagtattcccttgtgcatatataacactttttaaaaagttaatttgtctgccgataggtggttaggttgattctatagcttggctattgtgaagagtgctgcgataaacatggaaatgcagctattcctttgatctgttgatttcttttcttttgggtgtataccaagtagttggatttctggatcacatggtagctctatttttggttttctgaggaacacctcaccacgcaaaacagataaagcaaattacaaccgaaaatagagatggacagatttataaccagaggtcctgaacaagtatcagagaccagtcttagatactaatctaatgcggaccatcttagatactttaacattttcaattgagagaaagatggagacaggaagctttggagatgaagacatggtaggtaaaactcactcatctctataagaaagggaaaaataatcctagtctctggtgtgaaagatctggaagactgagaagaaggtaagatatttgaggatgctttgaactctatcatgaatactttgaatttcttcaagaggagatcgttcatactacattgctccattccctggcagcaaccagcctaggtaggtttgctgctgattgacagttcattgatcacagctctgcaagggaatccagatgggttagaaccgcagctatgtctctcctccaagcccacagagttcttgtaatatttctttcttcacgtaacaaagctaatctatttctgaagaaataggttctgttggcactaatacagaaaagaaaaatattttagaagtcatggttaacttactgaaaaacaaactatcaagaactaatcaagacacatccccaagtttgcctttctaatatttaaaaatttatgtttgatgctagcagatatctctatcaacacactaaggctggaatttattttataattttcgggactgaactttagatgaagacatttttattttctgcctggaaagaagttagtcattgatgatgctaacacaggaaagaaaaaatattttattctttatttttatttattttatttttgagacagagtttcgttctgttgcccaggctggagtgcagtggcacgatctcagctcactgcaacctctgcctcccgggttcaagtaattctcctgcctcagcctctccagtagctgggactacaggcaccggccaccacgcctgggtaatttttgtatgtcttgtagagatgggttttcgccatgttggccaggctggtcttgaactcctgacctcaagtgatcctccctcctcaacctcccaaagtgttgggatttacaggtgtgagccatcatgaccagcccagaaaaaatatttaaaaaaccactgtgaagttattgcaaaaagaacctatcaaaaaactatggagaagcccagctttcctgttctaccatttagaaatagttgttttaagaagtctgtcgttccacatagcccaacagcctgttagggagacggcaaatgtccaggcacaatattgttacgttgcatgagggtggaaggcaactgctgccaagttccagccgttgtcctcacgttaaaaagaagaacgagttgattggagtcactcatcactccagtgcattcggcgccatgagattacatgctcatttggtcaggggtttagggttatgagtttggtgtccttgataagatgtatagtacagctgtcctttcctgcctgcaaccatgactccactagccataggctaagtcttcagaggacgcaccatctttgtagttcaacgggaagtggaagaatatcgcgaagatgactaaggcactgtggtgggagacctaacctcagcttcacgtacaggtcggcgtgccgggtactactcatcaggttgattttttggttattcctatgcttggttctcccaagcctctttatttgaattcatgacttctttggcatgtgcattgaccagttaaatatgtccttgctaatagagaatagctgtactacgtagaagggaacaaacagcaaattcacagtatcaggctcactgtctatgacaccagcatcatgagggcctgtggatacctctctcctgtctgcttcaatccccaacacaatgaaatcaacaagaagaactcaaaagcggctctcacctgtacagaaatgaaggctgctaatactgtaaaagccaaatagttatttatttttagaattaacacaatttgtttcaccacctcatcacacaaaacagataaagcaaattacaaccaaaaatagagatggacagatttataaccagagatcctgaacaagagtgtagaatagacaaaaaagaaaagtaaagataaaacagaggacaccattaatgtgtagaaacacgggaatctgaggatgcaatggtttatcaaagtgttgggaaaaaatgacttatcaggtatgtggtttaccaatacagctgtcccttggtatccatggggggttggtctcaagacctcacgtggataccaaaatacccagatgctcccgtccctgatgtaaaatactgtagtatttgcatattacctacacacatccttttgtatatattaaatcatctctagattactcataatacctaatacaatgtatgtaaatgccacataaaatagttgttatattgtaccctttagggaataatgacgagaaaaagtctgtacatattcagtacaaacaagaccgtccctaaaaggaccataagcctaaatgtaaacccaaaattataacacttctaaataaaacataggagaaaatcattgtaatattcagataagaaaataatttttttagatttatcaaaaaagttgcaagctataaaagaaaaaagtgatagattagtcattatcaaaatttaaaatttctgcttttcaaatgtcaatatcaagtaaataaacatgtgacctcagtccattagtggagaaaaaaagaaaagaaagaaaaaattaaaatattaaatatgaacttaaaagaaagtttaaaagaaaagaaaaagacaagccgtggagtagaagcaaatagtcatccctctgaactcagaggttctgcatctgcgaattcaatcaactgcagatcaaaagtatttcataagattttctagaataaagaatctagaatagcctaaaattttttgaagaagaaaatcatttgaagactcactacataattccaaaatttactataaagctagagtaatcaagtttaaaagagtaatcaggatggtgttctaatgctctaaatttttaaaattgatatttaatattttaatttttttctttttttctttttccccactaatggagtgaggtcacatgtttattttcttgacattgccatttgaaaagcagaagttttacattttgataatggctaatttatctttttttcttttataacttgtgatttttgtgataaaacttaaaaaaaattttcttatcaaaagatcacagtgattttctcctatgttttcacttagaagttttatagttttgggtttacatttaggcttatggtccacattgagttaattttttaatgtggcttgaggtataggctgagatttattttccttgcatttggatatccaatttgtctactgtcatttattgaaagacagtcctatctctactgaattattttgagcatttgttgaaaagcagtatacgtgttggtcaattcctggactctcctatttcattgatccattgaaacccttatttcaacactacactgtctcaattagtctagctttatagtaaatctgggagttatgtagtgagtcttcaaactattttcttcttcaaaaaattttaaaccattctaggatctttattttcccatgtaaattttggaataagtttcttcctttcaacataaacctttctgaaattgtgattgagattgctttaaatctatagatcaatttgcagaaaattgatgtcttaaaaaactttgaattttccaatcaataaatatagttcatttctccatttatttctcttatttggtgctttgtggcttttctcatacaaatttttcacataaaaatgctatccctaaatacttcatgctttctcatgttatagtacatgatactttaaaaagctattcccagctattcattgcaaatatatagacatttttaaaagttgttattgtattgtgtgatcttgctagtcttactcattatttccggcagttttttcagtgataattaacataggaaatcattgtatctgatagtaaatatagttttatttcttttaagatcctttttaggcatggcacggtggctcacacctgtattcccagcactttgggaggccaaggcagataggtcacctgaggtcaggagtttgagaccagcctgaccaacatggtgaaaccccgtctctactgaaaatacaaaattagccaggcatggtggcacacgcctgtaatcgcagctactcaggaggctgaggcaggagaattgcttgaacctgggagatggaggttgcattgagccgagatcgtgccgttgcactccagcctgggcaacaagagcaaaactctgtctccaagaaagaaaaaaaaatcctggctgggcgcggtggctcacgcttataatcccagcactttgagaggccgaggtgggtggatcccctgaggttgggagttcaagaccagcctgactgacatggagaaaccccatctctactaaaaatacaaaattagctgggtgtggcggcacatgcttgtaatcccagctacttggaaggctgagacaggagaatcccttgaacccgggaagcagaggttgcggtgagcagagatcacaccactgcccctcagcctgggaaacaagagtgaaactccatctcaaaaaaaataaaagagaaaaatccttatctgggatgtattattatgtgtcccattacaaagcaggttttattattattgctttctaatacaaggcataagatatattttctaatataaatttttaaaattcattttagtttagattcagggtcccatgtgcaggtttgttatttggatatattgtgtgatgctgaggtttctattaaattcatcacccaagcagtgaacatagcgcccaacgggtagtttttcaacccttccctcctccctccctcctgcttttcggagccccccagtgtctaatgttcccatcttcatgttcatgtgtacccagtgtttagctcccatttgtaagtgagaacatggtgattggttttctgtttgtgcgttcatttactccatttctcatataaaattagaagtatatgactttttagtgattacataaaattttttcaaagggtagcaatataattgcaaatgaagttcagatttatgaaattgccataaattgctgagctgtggagagctctgtgtcgcagccaaggctgtctgatcttttcgcctttggggcatgcattgtcacattcctcggcctcatcatttcaggatcagaacttagctttcttctcttgtccactggagtgtaatctcccagagagcatgcatgagttttcctaaagactcagtacgctgtcctctggacctgaggcatgacgcagtcttcaccaagtacccttcaggtagcttgggacccaacgtcccttctcctcattttccttatctgcactgtctgtgtctctgcagggtcattgacggccgagacctcatgcccttgctgcagggcaacgtcaggcactcggagcatgaatttcttttccactactgtggctcctacctgcacgccgtgcggtggatccccaaggacgacagtgagtgctcaacccgttgcttcctgttccctgccaggagcagggtcactcaggtgtatcctgaacgcattcttcctttcctctctagaccggtcctttcattccagggctcactgaacacatggttttggagaagtttctcagaattgctcttctgcagaaaggcaggtgggggtaatggagatgctaattggcttcacttaattatctcagcagtcgcacatacattaaaacatcacattgtgcatggaaaatctatgcaatttttacttatcgattacactttaataaagaaaacagatgtatgaacataagatttgcctataaagttagagagacacttttacgaaacatacatttttagtcaggtgtggtggatcacgcctgtaatcccagaactttgggaggccgaggcgggcagatcacttgaggtcaggaatttgagaccagcctggcaaacatggcaaagccctgtctctactaagaaatacaaaaattagccaggcatggtggtgcacacctgtagtcccagctacttgggaggctgaggcggtagaatcacttgaacccaggaggcagaggttgcagtgagctgagatcacaccattgcactccagcctggaagacagagtgagactccatctcaaacaaaaacaaaaccaaaaaatatatatacatttttagaaacaggactgatatctgctggaaaatgtgtatatcatttcaccagggaactctaatgttctcgttttgttgtaaggattgcataatatttagcattgacgtgtgggcaaaaagaagcccaagaaccagccttgagaagacggaagaagacaagagaagccagcaccttgggtgcatgcctctgatgtgctttctttctttcttttttttttttttggagataaaaaaatatgtattgaatatcttctatgggcaggttattttgtaggcataagtggtcatggctaaactttcatttataaaaatcaattctaggcagactaaagataaaatgtaagattaaaagtgttagaagaaaatgagtttatgacccagaaattggaagttttttaaatttttaaaaagtggcacacatataataatatgcacacattgcacatgaaaattggggatatctagtgatattttgagataggcaatgcatagtgatcagattagaataattggcacatccatcatctcaaacatgcataatttctttgtgttgggaacattgaatatcctccttctagctatttgtaactatgtaacatattattgttaactatagttattctacagtgtttagaacaggagtccccaacttttttggcaccagggaccagttttgtaaaagataatttttctgcagactggggtgggggatggttttgggatgattcaaatgcatgacatttattgtgcactttatttctatcattattatattgtattacataatgaaataattctacaactcatcatcatgtagaatcagtgggagccctgagcttgctttcctgcaactagatggtcccatctgggggtgatgggagacagtgacagatcatcaggcattagattctcatacgtagcctgcaacccagatccctcgcatgcacagttcacaataggtctcgtgctcttatgagaatctgatgcagccactgatatctgacaggaggaagagctcaggcaataatgccaacgatagggaatggctgtaaatacagagataaagcttcgctctctcccccaaccactcacctcctgtgtgtgaccaggttcttaacaggccacgaacaggtaccagtttgtggcctggggactggggacccctgctatagaacactaggacttcttcctttgatctggctgaagtgcgcatcatttgacgagtctctcttttctcctccaggtgggtcagtttggaaggctcactatgtgaccccggtattccagccaccagcttctggtggctgctatgtcacctcattatgcagatgtttcggagaacaggttacctaccacaacccccctctgctcttcgatctctccagggacccctcagagtccacacccctgacacctgccacagagcccctccatgattttgtgattaaaaaggtggccaacgccctgaaggaacaccaggaaaccatcgtgcctgtgacctaccaactctcagaactgaatcagggcaggacgtggctgaagccttgctgtggggtgttcccattttgtctgtgtgacaaggaagaggaagtctctcagcctcggggtcctaacgagaagagataattacaatcaggctaccagaggaagcctttggtcctaacgagaagagataattacaatcaggctaccaaaggaagcactaactttggtgctttcaagttggcaaggagtgcatttaatagtcaataaattcatctaccattccagattattaaaggcccactggttgttccact

SEQ ID NO: 1329 - DNA, 28436 bp, Homo sapiens
tgtggcctgagaggacggccaggactggccagaaaagagaggtgtggaatgcagtaagaaaagtgacgcggaccagaggggtcttgcctgttccgagagaatggaaggggttagccacggtgggaacggccacggcgggaacggccccgccagtgaggagcgcaggcagcaaggcttagcggaagaggcgtgacccaggcgtaccgcaggggcgtggcccgaacgagctgactttagcccttacgtgaaaggcgtggcgtagtcgcaagggtgtaaaaaagaaattcgaattcgcgggacggtcggcctcaggcggagtagggacgtgagcccaagggagggaggtggggtaggcagactagttgtgactggatgatcactgggcgaagggtggaaaagtggccacagatggaaaggcgggctgcggagtagtgaccggcaagggaggtggcgcgaaaagggaagtagggacatgacgtagttggaacgcagagacgtgcctcgaacgtggggggcgcggtccttacgtgtgggcgtgccttgttgctctgaggggcgtaacaaagatggtggagcaggcggagggcagaggcgtcggcaagttagcgtgcaggcgcgtggcagcgacaggagatgtgtagccagagcgcagagcaggtgtggactccggcgctggggaagcgtggccagggcgagatttcagcctgggtcggggacagaatggggactgataggggcgtaacctggaatgacgaaatgacgtttgctgcgtagggacgtggctaaacgtgagggggcgtggccaagatggccgcgtgcgggatcctcgggtaccgggagcgaacgaggaggttctggctcaggtaagtcgttcgggtaagggcgggcggcagtaaggagcgtgggcagcagcagggcgtggtctgcttgagagggcaggaactgtgccacttgccgcaaacatgaccgcgtgccgctatcggccctggagccagagaagcttttggtgcggcgaggttggccggggccctggcggggcttctctgaggaatgggagtgggaggctggcggcggggaaatagccacttccccactctagccctctttctccgctatggggatcaccagacatccttttaggattctgtctattaaaaagtagaacagctttcccagagacattgcgggatgagaggagtgtccagaaaccaaggagcagcaagctgggactccctcgggtctgcattgttgatattcccacctgactatgctaggggctatggacagacacagccaccccagagtagatcaaaagcacagttgtgtcccttggacaaatctgagtttttctgttgtgccttgccccagagccggaggagaggaacctccaaaatgcagacattcttggtggctgggattctgtgtgatattcagcgttaaatgctgctgctctgaggctgctggaaacgcgttagtattaatatctgtgtacttctctcacatttacttttgctggaaaagcttgggaaatgacttaacgaagatgcgtaaaccttaatttgtttatatgctccttattagccactgaataccacattgctttctgcttccccttcttctttactgataatctgaccatttccactatgcactttgaaagtcttgctggagtatggagaatagtcagaaatctctggtaagatgctgccccgcgcatctctcagaggagtcactattcatagcctgcatcagagttcacaatgaaccaaagttcaccccacctcccctgtcttcagggacttagtgaaaagctgcactgttcttgaatattttggaaatgaaaaactttctgggctattttaaatcagtacctgggctggaattaaccgaaaggcgaaacagcaagggcaccattctctgtgcctatacgtagctgccctgtgcttggaaccaagcaaaaaggctgccactgctcacagttgcaatggaataaaggttgagtgccttgtgattgcatatgaatattaaggaaatctgatggaaagagggaaattcatcatgtcactggccacactggggcagttagttgcaacacacaaatcaggtataatatattttgaaacctttggcaacctcagattgggatcacactctcaaggaagaagtgagtgagaggaggaagctaagctttcttaagacatagcagcgtaatctctaatttaagtttcaggaaattgcaaaaggcaggcttccttttgaaatcaggagttgagaaaatgaagagtcaatctgatgccaatcaaggaatttttcaatataattgtaaccttttgttagtacttttcctgtctctttcgcataagttgcttaatcaggcagagttcaagctatgaggcatttaataaatacattacttatgaatgacatttaaagacttttagaatcttttcttttttcacacatttctaaggctgcaaaacaacagaaaaagaacatgttagtaatatccaaggcatacatgaataatcagtgacagcaaaggatgtgtagcacagaaggcttagctctcctaggcggtatccagccacacactggtaattgttgaaatggagtattggatatatagatgatttattctcaccatttttttgtacaagtttgaagtttgccctaataaggggaaaacagattctaaattcagttgacccatggactattgctgtttaaacctgctaagtgaattcagatagtgaagttatttaaaaaccagatgctcttacctggctgcaggaactatcaagataagatattgaaagcttattggcagtctgtcttttaaatcctgagccagacttttttacatggcttcaacaaggtgatttttcatctccttagacattttgacatacacactcccactaaaaactgtatttacacaaacacagataaaactaaacaaaagtgattttaactttggtttgagaattgtcagcaccttttaggcaacgcagacatactttaggtgtcactggctgttacgagttcaattgcaccctcccatctcaaactcatatacgtttaagtcttaagccccagtacctcagaatgtgacctcatatggagattgggtctgtataaaggtaattatggtcattagggtgaccactagtccaatataactggtgtccttaattaaaagggaaatttggacacagacaagatgagaatggcttacgaaaattggatttaatgctgacacaagccaaggaattaccagaagcaaggtttattaggtgttctccagagaaacaaaaccaattgtgtgtgtgtatgtgtatatatgtgtgtgtgtatgtatgtatgtgtgggtgtgcctgtgtgtgtgcttgtgcgtgtgtgtgtgtgtgtgtgtttagagagagatttatttttaaaaattggctcgtgaatgtaggctcgtgaaatttgcagtgcaggccagcagactggagaccagggaagaattgatattacagcctgtcttactcagttttgtgctgtaacagaatacctgacactggataatttataatgaacagaaatttatgtggctcatgattctggaggctgggaagtccaagggcatggtgccagcatctgctcagcatctagtgagggctctctcttgcatcatcccatagcacaaggcagaagggcaagaacatgtgcatgtgaggggtgggagtggttgggggtgaagaaggagggagggagggaagggaaagaagccaaatttatccttatatcaggaacccactacctcagaaactaaccagctccccctaataatggcattaatccattcatgaggggagggccctcatgatttaatcacctcccaacacttttgcgttgcagattaagtttccaaaacgtgaactttggggacacattcagactggattgtgagcacaaactggtgccatggcacagctccagtccaaaggcagtctggaggtagaatttcctcttcctcaggggacctgtctttttcaacttaaggctttcgacggattgggtagggcccacccacatgaagggtaataatctttattccaagtctactgatttaaatgttaatcttatctaaaaaatacattcacagtgacatttaaactggtatttgaccaaacatctgggtaccatgacctacccaagttggcacataaaattaaccatccaagtagaaaggcctggaacagagcgctcattgccctcagaaggaaccaaccctgcagagaacttggacctcagatttctaacctccagaaccatgagacaacaaaaatttttaagccaaccagtctatggtactttcttacgagctaatacattggcctaaagacctccggtagggagtcaagcctagaggtaaggaacctccacaggattcactaacttcctaccagtcccctttaatgtaatggctgcacatctctggctccctgagttcagcgcacattagcaaagtgatgcatatgcaaagcaaagcgcatggcactgtgccaaaagactggcttctcatcctgctgtgctttatttcacaatgcacatagagatgattctcgctcctttcacgtaggtgtagtcttctctctagcttagatggagcaggatcaaggacagcagtacagaggagaagagctagttcacagccaattactagcatgaatgtgcacaaagagaggggaggatgaaagcacgtttgcctcctttctcagcatcactgaggaccatgatgtgggttttatatcttacattcttcttggaaagatggtgtaaagaaataaagttcagatttgtaagggaaatgtgtctttagtgcccctcaacttctacatttgtgccttttgccacccattcccacctaccccaacccccaccactaccccaccatggccatactgctgagagcccctcttttggcaagagaaggcagaatctgaggtggcaaaaaacaccctgctgcaaactggtttgctctgtgtttctcttacccatactatgtgcatttcaggaggctcctaagggagaaattacatacctggaaggtacagttcaagtcttggtcatctttgcatcatagcacccaccactgtgcttggagcaaaagaaatgacaatacattttgaaatgaaagtgctaactggcagaatcccagccctgtgagactagatgaggttcatactcagggagggtcctctttttagatcaggcaggatttggggggtcctttggatcttttagataggggtatgagaccctcctctcaaaggagaaatatttaaaagtgttttaaaagtatagacatccctacaaatgggtgatgacgtttgagaaaaggaaagacccctagtactgtctcagagcatgctggcagtcatggcacagttcttagttcttgaaatgcggaccaacatctttgtcaccaagggagcctactcgggtcagttggctagtactcccagcacccattttgaatgaggcactgtgtccctaagagatgcagctctgaccaaggcagacacggtccctaccaccatggggcttagatactggagaggatgcagtcataaagtacattcctggtgaggtattaattcgactgtgataagcactgtgaccacaaagcagttctgggctgacctggtgagcttgtggtcgggggagcttagaggaagtgacgctggtgtcagtcacctgaagtgggggtagggattcaccagtcacagatggagggagagtccaggaaaggaagggcatctgcacaggccagagggaaaggcaggagttggaagaactaaagtccatgtggctggtgggcgggcagaagcgcaaagtgaatgtgagtgaaagcaagtgggtctgtcatcttggggtgaccaatgagtttgaggaacaagagtggataattgactcccatttgccctccccttcacctcagggtgcgtattacgagtctgaatattgtcctacttagaggttttctcatgatcttaagtctctattgtttacagctttcacttctctgccctcttccctctaggttattgggttcctgcaagttatctgggaactgatcaaagtttcagggtaagatggtggtgatgaacaccctgagggtcactcgtcctgtgtccccatgcaaattgctgtggagaagcttccagattccaaggcccaggccattctgcagcctctgtacttgtacttacaaaatccagaaataagcctgagagtacaccatttcattaaagagaggagaaaaggcttgttggttttataaaaatcacgcgtgttaagcgtttgtagctgtgatgtcatgggcattccagtgtgagattatatgccttatggactgtgagaataactgtttctctatttgtccagtaaaataaatgtggaacattctttcttgacaaatgttaaaatgttaaaatgatgtcatgcagaaactggagaaggtttcagatattctggaacctgttctttattatttctggttagcagttgtctttttactaaggttgatccacaaactgcagattatttctgtgaatcttaaattgctggaagctgcacatgaatgtttgcaagcagttcagtggcttcatgcttcagaatattctgtccagagttaagaattgcagaattaattctagctgactgatttgcaagtgtgtactctgctgtaaacacagaagatcatgtgacacagcaaatgttcttcctcaagcctttctcatctcgttcccctcctggaaatacaaggtactatctgcagctggatgttgcagggattctccactgtggcacgatggacattggggatggatcattctgtggcgtgggggctgccctttgctcactggatgttgagtggcatctctgatctcttgccagtagcactccccaaatgatcacattcagatacgtttcaagacattgctaaatgtcctctgggagggagggcaaaataaccctgggagagaaccgctgagatgataggagagatgtctgtgatggtggagagttgtgtttaatgaattggctaaatatatcttttgggtttttttaatatattttccactattcacaatgaatttacatagttttcaaatactggcttgtttcaggatttgaggtttctcagattgtgctcttcgggtttaccctttttgaacctccacgcacataagaaaaggaattccgttaataatgttgatttagctggatccattgccttgaaagtgcttcagaagaattttttattacaagtttattttgttttatcccaacattgactatgttctcattgaaatgagttggtcggggtcataacaaatttatgattgctgggtgtgcccatatcctacccagactggcttattccgaaccctgggactgcattctaaggcttaacgtggaaaaaatttagtcatatttatctagttactaacgttttgtgtgagtgtggggtttttgccttgatatttagtttgtctttatttgcagaaagttgaaagttaaatgcctaaagtccaatcagtctatgccattaggataacttgctgcttttagtgccaacagaaaccaaatagtggtcccccgaggagatggggttcacttgactaatagctatattatatgatgtgttcttgtttctaagttactagaaaaacacaggtggaagtcaacatttgattttgtttgtggtatgtttcactgttccaacctgttttccccaaggagaatattgtggtctttcttgccctgggcctttgagcaggtcctattcctatattctggaccctcatctgctcaattgtaaacacagttctcattgtttctgacagctcagtaccccagcagaaggctagtgtacgcttgtaaccaagaataaccccagattcttgagggttagaagctcagttatgaggccgggcacggtggctcatcccagcacttttgggagaccgaggaaggcggatcacctgaggtcaggagttcaagaccagcctgaccaacatagtgaaacctcgtctctactaaaaatacaaaaattagccaggcgtcgtggtgcatgcctgtagtctcagctactcaggaggctgaggcaggagaatcacttgaacctgggaggcggaggttgcagtgaaccaggatctgtactctgtctcaaacaaaaaaaaaaaaaaagaaagttgtggcagctacttctagtactttgttatcatcatcgtaggctcagtgcctgcctcagatgtttaagtctgaacattttaagaggaggcaaagcagaataaggagtgaatgaaagtaggaggttgtggcaaattcggtaagcagcatttcaggtcagcccagtgctctgtgctcatcatatctttgctcccaaggctctccacagataatctttagctgtcaactcagattgctgtttgctgttatctcaagtagcagacagtaactgttgatagtcctaactttagggacttgtaatataacaagataaaaataaaagcctacacctgttatccaagatgaaaataaaatcagtttcacttagcgtatcatctagtgaaatttagcgtgatgatcgcataaaaagatttaggtggccgggcatgatggctcacgcctgtaaccccagccctttgggaggccatgaggggcggatcacgaggtcaggagaacgagaccatcctggccaacatggtgaaaccccgtctctactaaaatacaaaaaattagccaggcatggtggcacacacctgtggtcccagttacacgggaggctgtgaggcaggggaatcgcttgaacccgggagtcggaggttgcagtgacccgagatcgtgccactgctctccaacctgggtgacagagcaggactctgtctccaaaaaaaaaaaagatttaggcatgagatcttaggccataggaaaattaatttaataatgttaattcttaatgaaatataaagagtatcagctataatgtaaatagtacaaatttaatattattccagtgattcttaatgttcatgatctccctgcttttagaaagaaaagaaacatttccttttaggataacttggactagaatggcgctgtctaaaatgtagccacaattaaatgtagccactgtgggtatttacctgtaaatttaagcacattaacattttatagcctcatgtgcctacaacttaccatactggacattttcatctttagagaaagttgtatttgacagcactgatttatattataactcaactgtgttataaagttctattatttttccaattaattttgaagaaccaaagcctggagaacaatacttgttttttggtttttgttttttttttaacttttattttaagttcaggggtatgtgtgcaggtttgttgtataggtaaacttgtcatgggggttttgtacagatgaggacaagagttttaacaggcttgttttgcaatgtcttcctaaagacctctgatataggctgggatgcctcagactgtactgtctccattaactttcaaataatcttgagaaacagtgggaggattaggagtcccatggaattgcactaatggcttcagggttgtcttcagctacctgggactgacgattagccctggaactgaccgccaagaaatgtgggcttttagtctcctgtgctgataactgcatgtgtattctatggctaatggactcagcatccaagtgccttttagagccctgatgctctaacaaggcaatttgtgatcctgcgattatcctcagccaagtcatacagagggtccctgtgtatacacccatcactgcactaaggccaaggcctacacagatggtcttcagtaacatgaggaaacagcacatccctcgtaaaaagggtggtacatagcaagggaccagataaaaagcacatgagggtatagggcaacattgtcctatagacatataattgagccacatatgtaattctcagttttctaatagtcacattagaaaaggggaaaagaaaacaggtgaaattaattttagtaacattttatttaacccagtatatccaggatattatcactttaacatgtgatccatataacagttattaccgagtttacattgtttaccttgcaccaagtcttcaaagcctgttgggtgttttacatttacagcaccactcatttaggattgaccacgggggcagcatggaaacaccagcgtttggaaagaatgaggagaatggttagataagtgaggagggttctactagaaaaacacaggcacttggacacagaagtttccacttgatgtactgtctttagcacaggagcaccctgacaaagccggtaatttgggaaaactgagtggctgaactcagggggtaaagggaagtgagaaaagaggacaaatgaccaagaggctttgtgtgaagtccatggcgtagagttcagaactaggctagtggtctgggcaaggcgaggaagagctaaacctgaacgattgttaaagaaaaataatgtgatcagtgggggtaatgggaaataaagcaaaaagaagcaaacttcttcggtgatatacttcatctgattcatttgatccaccgtagttgttgaaagccagcttgcttgcagagcagtgggggaggccgataactaagtgcgtgtgcatataattataactatacccatgtaataatgttgtgaaggacaaaaccagaatgctgtgattaaaaattcaaggggatcatgttataggagggtagtcaaagaggagaggaggtgacaattaaggcaataacaggagccagtgccaagtggaatgaggggaatgattccagcagaggagaagaatcaggaaccgaggggcttgaggcagaaatgagctttctacatttgaagagcccagggacatacaaggaggctagagaaataggtggtgcaagcataaaataaatcaaacgcaggactaggcatataaataagaattaagaccaagtgcatcctcaccatgaaatctaaaggagttttcttgctcatcagtgacagattattgacacctttttaatgacagtgtgcccttcactcatttaaactgtgattgaaatagtcacaatctcttcactttctacatataagaaaaacctgaaaatgaagcctctcagaatgcttcgtggtcaccttcctgttttgagggaaagtatgagaactgccaagaaatcatttctatctgtattttgttaaaatggtagaaggggagggaagaggaaaagaaaagtgtgaatttatcattagcaaaacaagcccttggcaaaaagttggcttcaatagggggataatgaccaaggaccacctctccccacagtgggttggatggtctagcctagatggtctttgtttaaaaaggaggaggtgggtaggaggaaagaaaccttctggaagctgaacttgtaaactcaagggcataaactgatcgtgtcattatggtcattaaagagcaattgaaggaacaggctcagttttcttgggctggtatttgcatgagtctgagtgttgatacttcccatttcatgaatgagatggggaacaattaaggatgaccaaggcatcgtcttagggagctgatcgtcactccagttcttccctagtcttcatggtagaccctgattgaatggctttgaagaatgtgaattctcacattatcaaccacagtctgagtgtctgaggggaaggtgcgtagtctctttgtgtcaggaatcttttaaaatataatcagggcctttcaagggctttctagaaggaatctgcattccaatcagatttatagtattgaaatattgtgccagttcaaatgcatttttaatttttggctcctaaatttaacagaaaattattgttctttttctgttgtattttttctgttttctgttgtaaatctattataaggaattctttcatactaagaaaaatgaaaacattgggttcaacctgttgggtattatgctcactggctggggtgataggactgttgggaccccaagcctcagtgtcactccatataccaaacctgcatgtgtaccctttatagttaaagttgaaattaattttttaaattaggtttaaatctctttagagataagagaatactatgttataggaagaaataggaaaaaaaaagaagaatattctgagtttctgcagactgagattctcacctgggccactattgacatttggggctggataacgctttgcactggtggcttcctcctgtgcttcgtagaatatttagcagcatccctggcatctatccactagatggcagtagcaccctcttccagttgtgacaatgaaaaatgtctctagatattaccaaatgtcctctggggccgtagtcactctccttgttgagaccactggtctggatgctcccaagagagctcagtgtctatactgccaggacacttttgcctaccaccacacaaaaataaagccaaggctaagattttaaacttccatctttgggctgctactgaagcaggagaactgtcgcccctgtaagagtaaaccagaagcaagtttctggtttttatggaaacaagaggatgtccctgccatattcgggggatttgactgggtgggagctgcctagttatttctcaaatccttcgacccattcttagtggtggggcaagatgcagagggtcattggtaatgatttctctcaattcatgtttctcctagttttcctattgtccttgattctacccatccatggtacttctaaaggacagggaaatggaccaccccaaactgatatacattggttctgctcatcacacatggggatctcaacaggccaatctgtgttaccagcaagtctactgatacttaccagggacttgctacagagacctggtgcttgactctggaagaaaatcagcatcagcaatgtcttcagtgcctatggaggatgaattgtatgtgtacaccttaatagataatctccacatccctgtgacacactgcaacctccagggaccttagcaatgccgatgttctacccaggttttgcaggatggctgcctggtcctcagagtttgcttacataggaggtgaactcaactcagcacgcacagttatgtggggcgagcatcttatgggatgcaggctacacaagtctttttttctaccagccaaccagttaaacactgacaatacttgattgaacatttcctttctcaaagttcttccatttctttcttttttttttaaatgagtctgttattgaaaatcgaattagtttgtctttgtatttagagctagtttgggggcttggggcttgggaaattctcaaagaagaaaagaaactcatttatgaatacctatttccacatggcgctaatctccatgcattttactgttatcacaggactgattgcacttggtttaggtgagcttagtaggcagactgagacgagttgggttttcaagatggcagaatgctgtttttctgcacagtgctttctgacttgtctttagcctttgctttagtcagctgcttaaggccctgaatggctaattgctaaagctcttagttcccattagccttgacagggtctccagaagtggaattgcctcatgtgtgatgctagatagtagacagtcttgataatagcctgacctgctttctcctagtgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcaggtgagggcaagatctggtggtcttgtaaggagttaaagaaacagtgtcatgttaacagaggacacatcaaactctctccatgatagtattgacctctttgtgagcaatggcatggaactcattggaatttaaaaaaaaattgtggtgaaatacacataatatgaaatttatcatcttaaccatttttaagaatacagtcaagtagtattatattaagtacatttccattagtgtacaatcatcaccaccatctatctccagaaatcctttcatcttgcaaaactgaaactttacccattaaacagtagcaccccattcaccctccctccagcttctcgcagtcagtatttggcttgcttgcttgcttgcttttcttttcttttttttggaaacagattcttgctctgtcacccaggctggagtacagtggggcagtcttggctcactgcaacctctgcctcccaggttcaagcaattctcctgcctcagcctcccgagtacctgggattacaggtgcccgtcaccacgcccagctaacttttgtatttttagtagagagggggttttaccatgttggccaggctggtctcgaactcctgacctcaagtgatctgcccgccttggtctcccaaagtgctgggattacaggcatgagccaccatacccagccagtattctgctttctgtctctgtgaatcggactactctaggcacctcatatgagtggaatcatacagtatttgtctttttgtgactggcttatttcagttggtataatgtcctcagagttcatcgatgttgtagtatgtgtcagaatttccttcccttttaaggcttaatgatactccattatatggatagaccacatttgtttatctattccttaccttttggcttttgtgagtaatgctgctatgaacatgggtgtacaaatatctctttttgactcagttttccgttcttttgggtatatgccctgaatgggctttctggatgatcactggactcacttttcagtgtatggaaaaattcccttctcttttatatggatgtttccttctactagtataggtaatattttctattaacaaatacatatatctgtatgtacagattttgtaattgatatagaagaaagggcatgaaatgaaatgaaagatttgccagaaatctattttctgtgtgtgtatgtgttgaatatgtactagttttccttggctggcttactttgcagataacttctatattaaatagtaattatgtttaattacattttaaaatgtaagattgcaatacagagcagaaggataattaggcaagaaaaacacattttatatttggggtcacctgataacgtgtatgtattttatcatttatatatttatgtttgtaacattttctgagtggcaactatgtgcaaggcactgcacaaagtaccaggagtactaattctcaaccacccaaagggcaaagtctagtgagggaagaatactcgaaattaaaattataaagcaagtgtgatttgaaaaatgtttctgaaagtgctatgggaccacagaggaaggcatgtgatacagaccactcagaggagtctatgatgatttcactaaggaggagccatttatattaggtattaaaggatgtatggaagtttgccaagaggattagaagggcattctagactgagggaaaatcgtgcaaaggcagatttgatagaatgttcaggaaatgaccaaaaaacaaaatgatgtgaccagaatgttgaatgtgtgttgtggggagaggcagtgagagtggtgatcatcaaagcataatagggtagatggagggcaggctcatcagaaactagttatttgtaaacaagagagtggcatagcttgatttcgtttaattagcagtttatgtttttagattaacccaggcaacaatgcagggccacaagttgcgattaatccaagtgatagatggtgagagattaaatgaaggcaatagaaatatagaaaatgagcaacttttaaaaagcatttctgaaataaaagcaacaggactaggaggtgagatcctcttccagagaacagaaagcaaagttaaccaagaccttgaggtgtctcacttaggagacttgggggaatggtgatgccagaaaataagttcatgagtggtggacaaggaatgatttgtagagaagttatcttaatccatttgtgttgctgcaaaggaatatctgaaactgtgtaatttataaagaaaagaggtttacttggctcatggtgctacaggctgtacaagaaacatggtgctcacatctgcatctggtgagggcctcaaactgtttcccctcatgttggaaggccaaggggagccaacgtgcagagatcacatggtaagagggagaggaggaggtaccaggctcttttcaacaatcagttctgtggctgaatgtgatggctcacacctgtaatcccagcactttgggaggccaatgcgggaggatggcttgaggtcaggaattggagaccagcctgggcaatatagtgagaccttgtctatacaaaaaaaaattttaattaaaaaaaaaaacaattggccaggtatggtggcccatgcctgtagtcccagctacttgggaggctgaggtgggagtgtcacttgagcctagcaggtcaaggctgcagtgagtcacagttgtgccaccgtactccagcctgcgtgacagagtgagaccctgtctcaaaaaaaaaaaaacccaaatcagttctcttgggaactaagagtaagaactcacttccacccgaatggcaccaagctatttataagggatctgcccgcgtgatccaaacacctcccatgaagccccacctccaacattggggagcaggtgtcaacatgagacctggcaggaccaaacagaccatatccaaaccatagcaaaagtatagggaaatcataaggaaatataattgcttcttacagcttttttgtaatttaggttttgtttgtttggtttattggttttgtttttttttttaataggctctcactgtgtcacccacgctggtgtgcagtggtgcagtcatagctcactgcagccttgaacttctgagcccaagtgatccttccgcctcagcttcccaagtagcagggactacacgattatgtaccaccacgccaaactcatttttaaattttttgtagagatgagatctcactgtgttgccgaggctgggcttgaactcctggcttcaggtgatgctcttgccccagcctcccaaagtgctgatgtgagccatcgcacctggcagcaatttagttttaaatgttgtatcaacaataaaaagaacattttaaatggtcatctctcaaagaagaaatgtgtcttcaactcttttttttcttttttttttttctttgagacggagtctttctctgtcacctaagtggcgtacggtggcgcgatcttggctcacttcaacctccgcctcccgggttcaagcgatccttccacctcagcctcctgagaagctggggttacaggcatccaccaccacacctgctaatttttgtatttttttttagtagagacggggtttcaccatgttggccgggctgatctcaatctcttgacctcaaatgatccacccaccttggcctcccaaagtcttggcattacagatgtgagccaccacacccggccagtcttcaactcttgtctaattcctataaggagaacttacttttctcaatataaacattttctctcctttaaatgtaaatggattttggatgttagtatttcatgcaaagcagaatgggaacgagcaaatgttgatcccttactgaaatgcgactcagtttgctatatgtattttattttatttttctccccgagtccttttattccaaagaaatattaattgctgtccttgcctaaatttcttcctgatctttgtttctatctcattttggattgtcatatggttttcttggtggctttactttgggtgaggaaacatgtttaaatgtcataggttgactgaggctgtgggtttattctggagagattctgtatagtcacgtgttaaccctcttttcatggtgtttcagctgcacttagtgcattggaacgcagtcaaatttgaaaactttgaggatgcagcactggaagaaaatggtttggctgtgataggagtatttttaaaggtaaaaaatctcaccaactttaaatgacgtgttgtattctaggatgaaaagatagaacagtataatattgttatttactttaagaatattgggatccctacactggtaagataaatagtgattgttaaggatatattttaaatggcatgaaaccgtgccatccaatagagtggtcacaagccacacgtgacagttgggcacttgaaatgtggctggtgtaacttaggaaatgaagatttaatttacttctaattcacttaaatttcaattaaaaaactgatattcaattcagttattgaaaaacttttgggttgggcgtggtggctcacgcctgtaatcccagccctttgggaggccgaggcaggcagatcacttaaggccaggagttcgaagccagcctggccaacatggcgaaaccctgtctctactaaaaatacaaaaattggccgggcgtgaaggcaggcgcctgtaatcccagcttcttgggaagctgaggcacaagaattgcttgagcccacgaggcagaggttgtagtaagccaggatcgtgccactgcactccagcctgggcgacagaacgagactgtctcaaaaaaaaaaaaaaaaaaaaaagaaaaacttttaagaatgtttggaaccatttggatatgtatatatatgttttcaagtataaattttttgaaatctaaatatagatcaagtatttttgatgaaaaaggtagcatccaaattgagatgtgctgaagtgtaaaatacacaacagatttttaaaacttagtatggaaaaaatataaaccatctcattaataacttttcgtattgattacattttgaagtgataatatattgaatatatttggtaaaataaaatattaaaaaggatttcatctatttttactttttaaatgtggtcactagaaaattaattacctctgtggcttgtatcatacttctgtttttaagcattggtataaaaggataaaggcgaataaataaataatagttaaaatgtaagattaatgtattttaggccaggtgcgatggctcacacctgttgtcccagcactttggggaggccgaggcgggcggattacttgagtccacgagttcgagaccagcctggccaacatggtgaaaccccgtctctactgaaaatataaaaattagctgggtgtggtggcgggcacctgtagccccagctactcgggaggctgaggcaagaggatcacttgaacccgggaggcaggagctgcagtgagctgagatcgcgccactgcactccagcctgggtgacagagtgagactctgtctcaaaaaatttaaaaaaaaagaatacattttaaacggaagaatgtattttaagcagaatagaaagataaaggcaaataactaggaaatcttgaagggaactaatattcatgagtgctaagtgactccatatttgccaagtgcttagtttatctttctaagaattcggcaatattattgtctccatttttcagatgaagaaagtgaagctcagcgaggttaagtgctttcttgctaggtcacacagctagctaacggaggactggggttaaaaatccataggccacactctcatggggcccctgagctcttgcaggttcagcagctacaggcttcctgcatgcttccaactttagtctgcactagaggctgagcgttttaagggtacctgggatttgttttagtcgggtacagtaagacatgcagacatgggaatgactgtcatgaaggaagaagttgatcctgtttccagatccctagaagctggaggcatggcacactgtgcagagccacatgaggaagcaccagggttggtcaagaggcagagaatgtgaggggaaaatgcgggcaagagcttttattgtggtttcagtgggaaggaacaggcgaggcagggtaagcaggcttgggattggctagtttgaataatttcagagtgttctggggcctagggggctgtccccacttggctgatacctgaccgtggagtgattggtgcaggagaacagtggccccagtctaagagcctgataaaggagatggtggggctgtaagctctggattgcatatgaaaggtgctcttgcagttgtctgttctctctgggaattagccagccttgggagggacagtgcttgtggtgtcaacaagtccccagatatcaaagcattaaatacaaaagctattaatagaaaacgtgctttatgtactgagtctcctggaacatgcccttgaggacttaggggcctgcgccgaaagcctggccttcatgtgctgtaacctgtttgaagagcttcagcctccagggtccctgtgggccaaggcttaggaaggcccggggaggtgagtggagcaggagcacctttccctgtggactgcaggcacaacgtcagacagcctgctcatgtgttctgtgtccagtttagttcggtgatgtttataacattctaaattgccagtttaagtggtttcagactgtgatttgcttttaggtaatcaccagatggtcatttttaattcatatttcattccaattctacagtgagatgtccgttgtttttaatgttttctcatttgttgttctttagctaggcaaacatcataaagagctatagaaattggtggattccatgccatcaactaagtgtggggtagtatttttcctaaattgcctgaaatatattttgtgtttcaatctcaagagtggagacattaccaaggcactttgaattgggaagtttaagtaggtgaactgtattccagttctctttcaacactgccttagaaggagacctgtaatttatgaatgaccctggccctgggtcacattgcaggggacagaagtgatcatgtgggtgggccagtgagctttctggttttgctgcagtgccgctgaggacttggggactcaggaacatattgctgtcccctcctctgttcctgacaccggctccttctaagtccttgtgaacacacccagagcagccttctgttctgtagctgccatcccacaggcagggagcagagcgcagttctacagaaacttgccttgtccagctggaaagaacaatgacccacatccttcaggttggatgcctttgtccagccccccaagattatttcttctatattcagaatctcaaagggctgtgctctggaggcccatatattgtctccttctccctttcatcccccactgtatccttctggtccccacctctttccccctgctttcctctccatttccctcttttttcctctctccccttttagtccaggtttctggctcctcctgatctgcatttcattttttgtttgtttctatcaacttttattttagatacagggggtaccatgtgcaagtttgttacataagtatgttgcatgatggtgaggtttggggtacagattccatcactcaggtaatgagcacagtaccaaatgggtagttttttaaccctctcccccctccagtaacccccagtgtctattgttcccatctttatatctgtgtgctcaatgtttagttctctcaagaacatgcagcatttggttttctgttcctgcattaattcgcttaggatgatggcttccagctgcatccatgttgctgcaaaggacattatttcattttttatggctgtgtagtattccatagtgtatatattacattttctttatccagtccgccgctgatgggcacctaggttgattctgtgtctttgctattgtgaatagtgtgacagtgaacatatgagtgcatgtgtctttttggcaaaatgatttattttcctttgggtttatatccagtaatggtattgctgcattaaatggtagctctgtttttagttatttgagaaatctacaaactactttccatagtggctgaactaatttacattcccaccaacagtgtatatgcattccctttttgccacagcctcaccaacatctgttgttttttgactttttaataatagccattctgactgttttaagatggtatctcgttgcggttttgatttgtacttttctgatgattactgatgatgagcatttttcatgtttgttggctacttgtatgtcctgagaaatgtctgttcatgtcctttgtcccttttttaatggggttgtttttctgcattgcattttaaaaggaaaattctcagtctcccttgaagaagtgaagcctccttctttatgcactggccactgtctaatacctcccagcaatactcagaggagactacctgctggaacctcactagaattgagagatcaaatggttttggctgttttcccactggagaatataaaaaatacacagttaattttagaaacaaaggctgggcatgattccatcctaagcagcaattcttcaggtagctgcccagaagggcctggagctcctctggaccactgctgatctccagatactccctgagaaccgtcacctcggcgtccaattcctgagtggttttcactactaaataatgactcagtgacccagtctcttggccaggacgctgttatggaatttgggtcgtttggcacttcctgcctggtgcccacctgtctagattactggacccaagtaggtccagtatctccctggtccagccctgtcttgagtccatcacctttatcattaagaagcagccagtagaggttgatgatgatcaggtacgttctctccacaattttcatctaaggaaatcctcgtctccccttttaaaacaaggctgggctcagactgtggcatcagttttaacatcttgtaatgcttatacatttttattgaagtgtaccaacgtcttatctcagtttggacatgaatttagagatatttcaaattagctagagagaagagttaaaacatagaagaacataagctttttacatctatatttgacagtgacatatgtttttattatacatgcattgtgtagattctctatgaaaattaagacccttttaaataaaaaaacgaaggctggaaatgggtgtattcaaaaccctttaaaatccttaagggagttttgctatagaatctcaggataaagacagactccgacaatattcatccagaaattttcatgtaagtcagttgtttgaaacttgggatttatttttctcttagaaactaagtctaagtggtggttactacatcagcacacaaaatcctgtttaattcataaactaaactgtaataataactgcgtttacttgttcatattggatttttattgactaaaagcttccagcctctttttcatgcagccaggataacagtgataccaaaacctatcaaagattagaccatcctacccccaaaatataacaataggccaatatctctaaaaaatatgtaacaacagaaaaaaaagctaaataaaatagtagaaatagaatctagcagtgcattagaagaaatatatactttgtccaggtagggtttattccagtaatccacagatggttcagtactaagaatgatatacttacaattaatggatttcatcccatcaacaaatctatatgatcatttccatggatttcctaaaatacgttagacaaaacccaccatccctttaaaaatttttttaataaaacagaaatgaagaattccctaactggatgaagtagatttatctcagctcaaaaataaatagtatgtttaatgtggaaaggatatcattaactccatggttattagcatactaaatattaaatttaattgaattaacctctggcaggagccaataaagttaggccaaaaaacataaagaacattagagaaacactaaaaactcctacaaagataattcagcaattagtggagtaccatgtcaatttatagaaatcaattccgttggcatatataactcacagttagttaaaagacataacagaagaaggaaacctacttataatagaaactaaaataatgttaataaacaacataaaatgttaagaaagctataaaacatttctgagggacacagaagacttgactttataaaattcataccctgtttttacataggaagatattataaagacacctttgatgtcagttctccttaagttgattccataaatttaatatggttttaataaaaataccaacagaattttaaaactagatatagtacttctagagttcatgtggaaaagcagataagcatgaatagctggaaaaattctaaaggaggaaaataaggaatgattagacccataaggctttaaagccacaataattaaatagtatgatactagcacatgaataggaagataaatcaaggaagaaaatagttcagaaatatgtccaaatacatgagaatttactttatggtaaagataggatctcagctcaatgcaggaaaagataaatccagtaaatggcattgggggacaactgagcaggcatttaggagaaaaagttggacccatcgttcaatcctgacaaaaatatattctggatggaacaaaactttaaaggtaaaaaaatgccatagaagtacgaggataagcataggaaaattctttcatacatccaagtggaggaagcttttctaactataaatcaaaacccagaagtaatcaagaaaacaactagcaattagactacatacaaaaattttaaaatcctttctgatgaaaatcaccgtaaacaaaagataaatgacaaacagggaaaacatttgcaactctgttccctcattcagctactatttattcaatgcctactatatgccagctactcttctaggtgtttgagacatcatagtgaacaaaacagagagttaattgccctaatatacaaagagtttctagaaatcagtttttagataatcaacagcaaatggtataaacagacagcttacagttaaggaaacaagaaacccaataccatgtgaaaaaattttcagccttgcttataaaaagtgacgaaacaagatgaaactacactgaaatacaaattttcacatatcagattagcagaaaccccaaaattgtattgctcacagtgctggtacaagtgtggagcatgggcagcctcatgtgttactggtaggtggtaatgacacatgaataaagatataataggctaaaaagtatgttgttttactaatagttaattacaatatcaaaggaagatacaatgctaagttggtactattgtagtagctatcagagtgcagtttaccaaacagcaatttatcctacacataaactgcagacctaaacaataatacatatacatagttattctttgcaccattgtttgcaaacaacctaaataccagtcacctctatggcattcctcctccaaaatttgtattccctcatctaaatcatgagaaaagacaaaaccaaactgaaaaaggacttctacaaaatacatcaccagccgtcttcaaaagcatcaaggtcatgaaaaacaaggcagaaaaactccagagtggaggagaccaaggaggagtaggttctggagaagacaaaggacacttgggcaatctaaagtctggagttcacttaacagtatcaacccaatgttaatttcttagtttgatgaatgcatcgtgattatataacattagaggaagctggatgaaaggtctcaacctcagcaccactgacattgagggcagatcattcttggttgtggagactgtcctgtgcattgcaggatgtttaattgcatccctggcctcgactcactgagtgcctatagtaccacctccccaggtcatgacaaccaaaaatgtctccagacattctccactgtcaattgcaaactcaccccttgttgaacaccactgatagacactaatccctaatatcaactaaccaatgaaatgctgtacctcttgttgtatgagaagaagaaacagacatcttctcaagtctatgagaatggcttttaactaatcaacaccttgattaaccagtagaaggcatatttagtgatgattcgcttatgactgcctgtacctcaccgggacaaaattgtggtttgttagagagtctttagccacaaacagaataacaaccactggcttatattgcaaaaaggatatgggaaattctatagatattggaaagaaaaatatattataagaagtctaggccgggtgcggtggctcattcctgtaaccgcagcactttgggaggctgaggcaggcggatcacctgatgtcaggagttcaagaccagcctggccaacatggtgaaaccccgtctctactaaaaatacaaaaaattagctgggcgtggtggtgggcgcctgtaatcccagctacttgggaggctgaggcaggagaattgcttgaacccgggaggcggaggttgcagtgggccaagatcacgccattgcactacagcctgggcaacaagagcgaaactccatctcaaaaaaaaaaaaaaaaaaaaagtctatacctactctgatgccattatcttgagatgtcttagatatgaataaaaagtcattccactcattatgagaactgtctttagaagaaaattatactgaattataccataggaatatctctaggttttgaaaatcatatacccagagatgattccataaataaggaatcaggcaaaaaaccaaaggaattcattggtgagaggagagtgttagggatctcattcccctgcaactactggctgaccccaaccctgcattgcaaaacacttggccccctctgacctcaaaaagcatttggtgcttcctcattaagctctatttattgtctttactattcacccatctgcctcagtctgggccaaatctattgcccaatcttcaattggttgcgacttttttgtctcttcccgattctggcattccagagggtcaataggttccttctccacgtgcttttgagggaaatgccccccccccaaaaaacttttcacaccaccttgaacagactctaaacttaggcactacagttactaagcagcctttggattctttgtttttgaagttagatcttttcagctattagtggaaaatgtgcctcactctactccaggattaccaatagaaatgaaaggacagaaatggcattagtgtttagagaagattatgtatatatggctgtatgaacactgaaaattatgagggtcaacataaaatcagcattacaggtactaaaacataaatcctgatggctttcaccgttttcttaagagcaaaattgcaaaaagtgatattaacagtcatcctagacgaatatgagcaaatgatttgtttttccttaaaagagcctccaagtgtattgtgatcattttcacactgatcaaagagagcacccttctgtcaacaggtatctgcagttttcaggacctggcagaaattcttctatgttctgcctttaaaggtcaggtacaaaagcagagacagctgccaggcccctctgcccagagctaagtgtctgggaccatgagtgggaaggactgaggcttgagcctccttggtcctccagacagcatggggcgccacttgccccttctgcagctgcgcgcggcaaagctgtggcctggccgtggcctcctgccccatgcaacagttggtggacagaccgtacctggcacacggcgccttgtgcactttccaacattttgatgctaaccgtcgctagtcactgagccctgacatttgatctctggccttgaccgcagatttcggaaacttctggcagcccagtgtctactggaaggcccaagccgcttgccagaaagctgcgccccgcccaaaagcactgggttctgcagtccaggcccttcctcagctcccaggtccaggagaactgcaaggtcacctacttccacaggaagcactgggtccgcatccggcccctccgcaccactcctcccagctgggactacacccgcatctgcatccagagagagatggtccccgcccgcatccgcgtcctgagagagatggtccccgaggcctggaggtgctttcccaacaggctgccgctgctgagcaacatcaggcctgatttctccaaggctcccctggcctacgtgaagcggtggctttggaccgcccgccacccccacagcctgtccgcagcctggtgaccgtgaaaatcgccccgccagagagcagaggaagcccgacgcccaggccatctgccttcaggtctgtgatgagaaacggagtggcctgttccgttgtgcccaggtctaggccgctgagcagagccctcactcccaggcagagttgtctgaatccttcct

SEQ ID NO: 1330 - DNA, 2120 bp, Homo sapiens
gcagaaggtgacgggaaacaggccgcagacctgaacttccaaccgtatgtaggcgagaagccggtgccgatactcccactatcccacaatgtcccactgggccccagagtggaagagggcggaggctaatccaagagaccttggggccagctgggatgtcaggggcagcagaggcagtggctggagtggccccttcggccatcagggaccgagagcagcaggctcccgtgaaccaccactctgctttaaaataaagaacaatatggttggtgtggtcattggttacagtggatcaaaaataaaagatctacaacattcgacaaacactaaaatacagatcataaacggggaatctgaagcaaaagtcagaatttttggcaatagggaaatgaaagcaaaggccaaagcggctatagaaacacttattagaaaacaagaaagctacaactcagaatccagtgtggataatgctgcatcccaaacccctattggaagaaatctaggcagaaatgacattgttggagaagctgagccattgtcaaattgggatcgcattagggcagcagtcgtggagtgcgaaaagagaaaatgggcagatctaccaccagttaagaaaaacttttacatagaatccaaagcaacaagctgcatgtctgaaatgcaggtgattaactggagaaaggaaaatttcaacataacgtgtgatgacttgaaaagtggtgaaaagcgtctcattccaaaaccaacttgcaggtttaaagacgcttttcagcaataccctgatcttctgaaaagcataataagggtagggattgtaaagccaacgccaattcagtcacaggcatggccaattattctacaaggaatagatcttatagtagttgcacaaaccggaacagggaaaacattgtcctatctaatgcctgggtttattcatcttgattctcaaccaatatctagagagcaaaggaatgggcctgggatgctagtccttacacccactagagagttggctcttcacgtggaagctgaatgttcaaagtattcatataaaggtctcaaaagcatttgcatatatggtggtagaaacagaaatggacaaatagaagacattagcaaaggtgtagatatcattattgcaactcctgggaggctgaatgacctacaaatgaataactctgtcaacctaagaagcataacctacttggttatagatgaggcagataaaatgctggatatggaatttgaaccccagataaggaagattttattagatgtgcgcccagaccgacagactgttatgacaagtgcaacttggccagatactgtacgtcaactagcactttcttatttgaaagatcctatgattgtttatgttggtaatctgaatctagtggctgtaaatacagtgaagcaaaatataattgttaccacagaaaaagaaaaacgagctctcacccaagaattcgtagagaacatgtcacccaacgacaaagtcatcatgtttgtcagccaaaaacatattgctgatgacttgtcaagcgacttcaatatccaaggcatatctgcagaatcattacatggcaacagtgaacagagtgatcaagagcgagcagtagaggactttaaaagcggaaacataaagatactgattacaactgatatagtatcccgaggtcttgatcttaatgatgtcacacatgtatataattatgatttcccaaggaatattgacgtatatgtacacagagtagggtacattggacggacaggaaagactggcacatcagttaccctcatcactcagagagattcgaaaatggccggtgaattgattaaaattctggacagagcaaatcagagtgttccggaagatcttgtagtaatggctgagcaatacaagttaaatcaacaaaagaggcacagagaaacacgatcaagaaaacctggacaaagacgcaaggagttttattttttaagttgaaaagttgtaccaggctactggaagattccaggcatgttaaagatatgcagtattgaatatatgtaaggaagtattggaaacatactagccatttgaagacataactaattcttaaataatactgctaaactttcaa
